United States Patent 10,463,711 (NUTRITIVE POLYPEPTIDES AND FORMULATIONS THEREOF, AND METHODS OF PRODUCTION AND USE THEREOF) - sequence listing, part 7

SEQ ID NO: 43013 - protein, 2732 aa, Staphylococcus hominis
  subsp. hominis C80
MNYREKLQKFSIRKYTVGAFSTVIATLIFLGSPQAHASEQLQKDGQVIQAKARDQEQTSNETSNKQVQSNTEPKASPVSESQKGNNETLNKVQTTDTLTNDLTSFSSQNENKDTSHTTTDLKENNEAKSQLNKLDDINVTEVNEGHNHDNRNRTRYEDREASDDTLVSSTSTTIDGDKLQAAYDRSYAEYQKIDREQSDNKKLAQIKSTFNKVNHFFSENNNSNQTLINELYKELEQANALIESLPQRQVRTISTRANREARAVRSSRRPVRGQGGTRPPSNTANTYTPPVVHNSRPKPGSKVKKNSDLYNNAKKEWYVENENDGSGYWSGTFLHATNKSAPYYTTRSHYRNMSPSSVRGIAEISSIRQNDGYLWTINFNKYHIKRNGMVFWFGLPKGQTPTGPVRFTVTDVNGRETASSGAGDGRDQSLSRMWDSAGGITSSAYNFRQGNPLNRSEFYNDSVNHIYNLGDFARGNENQPLTFFEREGVPNKIKVAGDDIYRYLTAQVDHNQGIDHIYAFQARGTDSYTIQFKTSGSSQDRLYYAAGGRGIEFNEINNYNQLYLEPLEQYNDRKTKIVDVIDRVLHIDHVESAYDVPERRIMKKHYLDSDFATHEYAEDVASYLSNPSDHVMGLFPRVPTDRYRGNFGVNPLNSYEIHEMFSEEKLKEAARTGRPIEIFVGFNVSDAYHNGETIKKVNLFVKPKLEQSIGFYSDNATDNKENSPESQAAHHAVFLQQEGQMLNTVTNGNSKDYHQNIRIQFKSNESANVWEISGYPPSLRIEDAVDRPNTELEKNKVLVGQLPPGRHVMTARIGNETKIFEVIAKPNPPVISTLAAQLGQKGGKKPTITVTHVPQDERAKVRLVSGGTDGAGPGTSPLGYTVLAEKMANLDGTVTFEESDYTNPLPNNGVIRAITYYEDPVQSNFSNSINVGLDTTPPTFSNVRGLQDKYYRGDNVNISIPVSDNAYGSGVEDASITGNSGLQAVFNRDASGDAGTLVITGTISNDVTWNSDILVQPVAHDRAGNTTNVSPYHLHIGKLSDDKPVQLFSQQELKTVVNPNSISQSERNDIINSLKAKNSSLTSFLSTFNPYMVDNDGRVVLTFKDGSTRIIDPAQVITYRPQRKSIYTEPGSSNTKEAFITIAKGQEYTIGPDLRKYFSLSNGQDIPNNAFTTINGSSIPSPQAISRLNAGIYTYNVDALNAYNHSSERLTIKVNVVDVNTLAENQRVYRSTTKNLSNDEITQVRNAFKDANPQLNLNDSDIRIENDEPLSNHPSRVRVTITKGELTKQFISTFDHMDFLKWINLRNDYTVTWTSQKLNGRGTDGGFEWSPDGKTIIYRYDATTGRRITGNDVLSLLRATPKHAGLRNHIEGQEKILAESGSARGFKPVGYSKGNSIYSDGEHPFTYDGQPIQVLDIVDSNTGYSNSVIARSDYRHTSSNSTVMSGDIPAMNGAAGFHLDKVLKQNGTGNGIMGAVDKQQLYLTPYGAKSYIERLGQSMSSTDNVINIVFVPTDKVTPNIVLDNYNDHVVFSGETFRNTLTLTDNFGIKNVTVPNDSQIPMNVLNHSILSGVAPNVSTPMSKQVKVKVTDGSDNETTAVFNVLIKPLKDKYSVMTTADESHPIRIANISNNASLSETDRQAIFNSLDISKSITNRNYVTDGSNEIRSREISNVHRSGNNANVEVTITYADNSRTSITVPVKHVIPNIRGIELFTVQGQPFPSGKGTNNNDFFVINNDHPLTDATVTWIGNGPDINSTTVGVPQILRANILFDGETTPIEKEAHYRVVKAKPKRVYQTTINGNFLSSNEGLSSNVGSFVEGIANYLPSGTNFDWAPGSGQPLSNSPGIFTETINVIYPNGQVDPVNVLFKVKPTTPSIDTISTKYKADLSGQSIKVNNVPNNAHVKLYTEDGREISNTTMTRNRDGSVSITIPGVLPLGNIKAKSIITVDHLTITEQNNSGSVVNSTRSESIESDLSTSSPVTKQLEAVDGGLKFVKGDNIDLNNPRTYINSNSDIIRVEWEQNANQWKNTIGTTTKRAIVTLSNGETRTVSIPVTIYAPATAKAPQRDVVGHALTYGDDAANYVTFENNYMNGATVTWKNNNAPNNNIAGVQSLTAEVRYNGINHVYNVPVKVYEYKYKFKKSEYSTIVGTSFDGNGNINNYVALENANGLPTDGFHFVWNQNTTASHNEQWSNLVHPTQAFKKEARFEVLDNQNHVFFTSDTAIFKVTNAAPNPATVTQNDVGDVVISPGVGKNLGVNVENIIVNPDRITVKKGNQVIGTFVKNNTGKWTKASDSINTPGLSVSPDGSEIIYDKMSVPNDTLINTESTTGNGELTSEAAISATYKVKPATPSNTTFAFKQNGEFEVIPNNANASTTKNPTDKVKISYVEKMGNSTEQSRELIVTKNNQNQWSMNNQLDYVTLDSRTGKVTFKANSLKPHVLINTESIAGNDDNFSHNTVGVVGPDHHDVVIHEIVKEPGERVSNEELNNAISVDNKDHANVNEGVSLPTNLQSDTTQAVPTRITYRDGSIEIVNVPIRTHADKSSIRNALPKLNAQGDTNGKTPLSVTAYNNEMQHLHDEIEAVRRKANEVLSNDRATNTDVVNVTNNINDVSLKIQHAISLLQNKADNSALVEAKRQLDVATAEQDPTSGMTQVTSDNYRAKKAEAERISSEAQGVINNGDATAEEISDEKAKVEEALTQLTEAKNALKADKSVLEQKRPGLNHVGVTEG

SEQ ID NO: 43014 - protein, 254 aa, Staphylococcus hominis
  subsp. hominis C80
MKKTIIASSLAVGLGLVAGNVSHADASENQINKEKLAQLAESNDQSLNQHPIQEGAYNYQFNLNGKTYHFWSDGTYFKWEYYPSNGSTVNSANQNVASTQTAQNVSYQNNNYKNINQSASTSNVSQHYANEAQTQQAPKTTQTKQATQTQQATQTQQAPANATTNQPKQSTSGSSVNVNSHLQQIAQRESGGDIHAINPSSGAAGKYQFLQSTWDSVAPAQYKGVSPAQAPESVQDAAAVKLYNTAGPSQWVTA

SEQ ID NO: 43015 - protein, 60 aa, Staphylococcus hominis
  subsp. hominis C80
MDFISNRLNKYSIRKFTVGTASILVGATLIFGHADNEVKAAEKSNTETIAQYNNEKNTHN

SEQ ID NO: 43016 - protein, 187 aa, Staphylococcus hominis
  subsp. hominis C80
MYFLKFLIFFENICIVNIILKCYIFIGVLYSINLKNRGVSYLKKKPNRRLDFLPNVQNKYSIRKFTVGAASILVGATLIFGAGQEEAKAAESDQTVTNQDNTSSPTDTTEQPSTEEKATSENITTDQPSPEEKATSENITTDESSAEEKATESTQTDELSAEEKAAESTQTDESSAEEKVAESTQTD

SEQ ID NO: 43017 - protein, 1623 aa, Staphylococcus hominis
  subsp. hominis C80
MNLFKKQTFSIRKFSVGTFSTLIATLVFLSHPGHAATHDAETNTSAPQTNESATINKQNTNIEQPHSETTSTNISNSNENNRNNESNTSSEHSINREREEGTVNNVINSTENNTNHNEKVTTNDVVSNENNHETTNVNQPHRRGKRSVDNTPSTTNTDPMAVNEQNTGQIINGTFTDNSQGATIPTKNLESAMNEANTVPGWHVNSNDQTIIPLIWGPKSLPAYNPYIFDKTNNKIGVVLSKYNGNFNQVPGIADPTVGSIYQDVDVTPGSEIQLHYISSSMNNIWGVNGARVYIYDANNPSTLLYKGTPDILQNPIGNFVGVFQVPETVSRLRLRFESALNRSTDSTNGHRLLTGPNNFGGGVLADVTINSGAYLTATVNNTHYFAQSGSINADRVYQEIGFRIENRGHSSSNKTEYTIVLPEDVTYVSTKNATGKFNAATKELTVKIDRLEAGASKNISIGLSLPTDRPIEKEFLGHLTYVTDGINMNRLSDSKDFGRNNGDHYTRYGVHNEFVSVDSAMRQGDIVLDKQTITVKMYKQHLRDKVTEIEDDLANLDQNDNSPEVWEAMQVVLRKAKEVLAETDEMPISELKDQATINSIDLNLDKAHAKLSLDKVARTKRALFMGNDTATIEEKNAVIQQVNQALQSSYTTVDQSMTSNDVSTNKDTGINEITMIDLTPTVKQAAIDELTERANAKKVEFDNNPDATVEEKEAAKATIDNLVSEATTNIMNETTNNGVAQQKTSSIDSVNAATITPTVRSNARTAIDNIASARKVEIDKDNNATLEEKNAAKTEIDNLVARAKADINSLNHNNEIEILKENKVNEISQVEAHPVKKNAAAQAIDQAAIAKKQEIDLIEDATIEEKEVAKAKVDKIVTEAKNNINQATTNSSVDDAQNEGITAINAVIPEVVKKSEARDTIDEVARIKKAAIDQTPDATVEEKEAAIAKIDQEVTKAKAQIHQALKNENVDTAKTNGTNFINAIQPEITKKMKARETIDEVARAKKEAIDRTLDATTEEKEAAKAKVDQAVTEAKGHINEAINNSGVDEAKTNGTTTINAIQPEVIKKSEARQAIDDIARAKKEAIDQTPDATTEEKEAAKAKVDQAVTEAKGHINEAINNSGVDETKTNGTTTINAIQPEIIKKSEARQAIDDVARAKKEAIDQTPDATTEEKEAAKAHINEAITNSDVDEAKTNGTTTINAIQPDVLKKSEARQAIDNEVINKKTEIDNNVDATIEEKEAAKSKVDEAAVEAKNNINHTEINQAVDKAKEDGVTTVSHIQPNIVKKIAAKTAIDEVARIKKEAIDQTPGATTEEKEAAKSKVDEAATEARNNINRALSNNDVDQVVHNSTASINNIQPDIVKKEQAKRGIDTQAKIKKAIIDQISDATTEEKEAAKSKVDEEVTKAKHSIDQAVTNSDVDQAKDRGNVAINNIQPEVVKKETAKTSIDQIALTRKNIIDQTPDATTEEKEAAKSKVDEEVTKAKRNINQAVTNNDVNQVEHNSTIAINNIQPNIIKKIAAKTLIDQVARAKKNNIDQTSNATIEEKEAAKQKVDEEVTKAKHSIDQAITNSDVDQAKDRGNVAINNIQPEVVKKETAKNAIDQIALTRKAIIDQTPDATE

SEQ ID NO: 43018 - protein, 770 aa, Staphylococcus hominis
  subsp. hominis C80
MINNIQPTVVKKSEARQAIDDLAKLKKATIDLTQEATEEEKEAAKSKVDQALTEAKTHINEAENDEGVDEAKTKGINVINTIQLEIIKKVEAKHEIDQSAIAKKKIIDQTPDATEEEKEVAKQKVDEEATKAKDNIDQASTNDAVDQAKTTGNTEINNIQPEVVKKSLARQAIDEVAKVKKEKINQMLDATEEEKEAAKQKVDEEVIKAKNNINQATTNDGVNNAKTTGKNTIENIQPEVVKKAEARKAIDEAATLRKNLIDQDNSTTKEEKDIAKQKIDDEVNKAKRNVDQSINNSNVDHAQINGISAINNINAVALKKTQAKKSIDDEVTAKKAEIDSNHEATNEEKEMTKRKVDEAATKAKHNVDQSTTNDTVDQSTQIGISIISNIQPETIQKSLARQAIDDEATIKKAEIENNHNATKEEKDVARQKVDEEVIKAKNNIAQSTTNSDVEIAKESGKHAIDEIQPEIVKKSVAKQTIDELAKQKKAEIDQTPNATKEEKDAAKQKVEEAVMRAKKLLEGANTNSDVDQTTEQGKQSINSIQVEVIKKADALSKLEVELQKLKDKVLSDQTFTIDEKLFIKQKLDESYKKAEEKVNQAQTNKQVDNIKIHYLQEFNKIVLIDKVKLKAKSQIFDVANKRKAYIKGLTNISEYNRNKAYKQIDVYVMKALNKLAENVTTNDINELTRVTINEIEHVNVKQFENNFGLVNDNKVTFNNFNNKFNVNNNHSKLNTLPYTGENENSLLSLAEFTLLSGLLLLLKRRKKEDK

SEQ ID NO: 43019 - protein, 291 aa, Staphylococcus hominis; identical to SEQ ID NO: 43004
  subsp. hominis C80

SEQ ID NO: 43020 - protein, 434 aa, Staphylococcus hominis; identical to SEQ ID NO: 43000
  subsp. hominis C80

SEQ ID NO: 43021 - protein, 291 aa, Staphylococcus hominis VCU122; identical to SEQ ID NO: 43004

SEQ ID NO: 43022 - protein, 256 aa, Staphylococcus hominis VCU122
MRAKKLLEGANTNSDVDQTTEQGKQSINSIQVEVIKKADALSKLEVELQKLKDKVSSDQTFTIDEKLFIKQKLDESYKKAEEKVNQAQTNKQVDNIKIHYLQEFNKIVLIDKVKLKAKSQIFDVANKRKAYIKGLTNISEYNRNKAYKQIDVYVMKALNKLAENVTTNDINELTRVTINEIEHVNVKQFENNFGLVNDNKVTFNNFNNKFNVNNNHSKLNTLPYTGENENSLLSLAEFTLLSGLLLLLKRRKKEDK

SEQ ID NO: 43023 - protein, 103 aa, Staphylococcus hominis VCU122
SDSDSDSDSDSDSDSDSDSDSDSDSDSDSDSDSDSDSDSDSDSDSDSDSDSDSDSDSDSDSDSDKKLPDTGENNSNGVLFGSMFAGLGALLLGKRRKRENKEK

SEQ ID NO: 43024 - protein, 263 aa, Staphylococcus hominis VCU122
MKKTIIASSLAVGLGLVAGNVSHADASESQINKEKLAQLAESNDQSLNQHPIQEGAYNYQFNLNGKTYHFWSDGTYFKWEYYPSNGSTVNSANQNVASTQTAQNVSYQNNNYKNINQSASTSNVSQHYANEAQTQQTPKTTQTKQTTQTQQTPKTTQTKQATQTQQAPANATTNQPKQSTSGSSVNVNSHLQQIAQRESGGDIHAINPSSGAAGKYQFLQSTWDSVAPAQYKGVSPAQAPESVQDAAAVKLYNTAGPSQWVTA

SEQ ID NO: 43025 - protein, 212 aa, Staphylococcus hominis VCU122; identical to SEQ ID NO: 43012

SEQ ID NO: 43026 - protein, 434 aa, Staphylococcus hominis VCU122; identical to SEQ ID NO: 43000

SEQ ID NO: 43027 - protein, 87 aa, Staphylococcus hominis VCU122
MSKRRQGPINKRLDFISNKLNKYSIRKFTVGTASILVGATLIFGHADNEAKAAEENHMENTSLNSIENDNDKNNQKIDSSNETATTS

SEQ ID NO: 43028 - protein, 992 aa, Staphylococcus hominis VCU122
MNLFKKQTFSIRKFSVGTFSTLIATLVFLSHPGHAATHDAETNTSAPQTNESATINKQNTNIEQPHNETTSANTSNSNENNRNNESNTSSEHSINREREEGTVNNVINSTENNTNHNEKVTTNDVVSNENNHETTNVNQPHRRGKRSVDNTPSTTNTDPMAVNEQNTGQIINGTFTDNSQGATIPTKNLESAMNEANTVPGWHVNSNDQTIIPLIWGPKSLPAYNPYIFDKTNNKIGVVLSKYNGNFNQVPGIADPTVGSIYQDVDVTPGSEIQLHYISSSMNNIWGVNGARVYIYDANNPSTLLYKGTPDILQNPIGNFVGVFQVPETVSRLRLRFESALNRSTDSTNGHRLLTGPNNFGGGVLADVTINSGAYLTATVNNTHYFAQSGSINADRVYQEIGFRIENRGHSSSNKTEYTIVLPEDVTYVSTKNATGKFNAATKELTVKIDRLEAGASKNISIGLSLPTDRPIEKEFLGHLTYVTDGINMNRLSDSKDFGRNNGDHYTRYGVHNEFVSVDSAMRHGDIVLDKQTITVKMYKQHLRDKVTEIEDDLANLDQNDNSPEVWEAMQVVLRKAKEVLAETDEMPISELKDQATINSIDLNLDKAHAKLSLDKVARTKRALFMGNDTATIEEKNAVIERVNQALQSSYTTVDQSMTSNDVATNKDTGINEITMIDLTPTVKQAAIDELTERANAKKVEFDNNPDATVEEKEAAKATIDNLVSEATTNIMNETTNNGVAQQKTSSIDSVNAATITPTVRSNARTAIDNIASARKVEIDKDNNATLEEKNAAKTEIDNLVARAKADINSLNHNNEIEILKENKVNEISQVEAHPVKKNAATQAIDQAAIAKKQEIDLIEDATIEEKEVAKAKVDKIVTEAKNNINQATTNSSVDDAQNEGITAINAVIPEVVKKSDARDTIDEVARIKKAAIDQTPDATVEEKEAAIAKIDQEVTKAKEQIHQALKNENVDTAKTNGTNFINAIQPEITKK

SEQ ID NO: 43029 - protein, 755 aa, Staphylococcus hominis VCU122; identical to SEQ ID NO: 43010

SEQ ID NO: 43030 - protein, 2731 aa, Staphylococcus hominis VCU122
MNYREKLQKFSIRKYTVGAFSTVIATLIFLGSPQAHASEQLQKDGQVIQAKARDQEQTSNETSNKQVQSNTEPKASPVSESQKGNNETLNKVQTTDTLTNDLTSFSSQNENKDTSHTTTDLKENNEVQPQKNKLDDNSLGEVNEGHSPRDNRTRYEDREASDDTLVSSTSTTIDGDKLQVAYDHSYEEYRKIDREQADTTKVAQIKATFNKVNHFFSENNNSNQTLINELYKELEQANALIESLPQRQVRTISTRANREARSVRSSRRPVRGQGGTRPPSNTANTYTPPVVHNSRPKPGSKVKKNSDLYNNAKKEWYVENENDGSGYWSGTFLHATNKSAPYYATRSHYRNMSPSSVRGIAEISSIRQNDGYLWTINFNKYHIKRNGMVFWFGLPKGQTPTGPVRFTTTDVNGHETSSSGTGDGRDQALSRMWDSAGGITSSAYNFRQGNPLNRSEFYNDSVNHIYNLGDFARGNENQPFTFFEREGVPNKIKVAGDDIYRYLTGQVDHNQGIDHIYAFQARGTDSYTIQFKTSGSSQDRLYYAAGGRGIEFNEINNYNQLYLEPLEQYNDRKTKIVDVIDRVLHIDHVESAYDVPERRIMKKHYLDGDFATHEYAEDVSSYLSNPSDHVMGLFPRVPTDRYRGNFGVNPLNSYEIHEMFSEEKLKEAARTGRPIEIFVGFNVSDAYHNGETIKKVNLFVKPKLEQSIGFYSDNATDNKENSPESQAAHHAVFLQQEGQMLNTVTNGNNKDYHQNIRIQFKSNESANVWEISGYPPSLQIEDAVDRPNTELEKNKVLVGQLPPGRHVMTARIGNETKIFEVIAKPNPPVISTLAAQLGQKGGKKPTITVTHVPQDERAKVRLVSGGIDGAGPGTAPSGYTVLAEKMANLDGTVTFEESDYTNPLPNNGVIRAITYYEDSVQSNFSNSINVGLDTTPPTFSNVRGLQDKYYRGDNVNISIPVSDNAYGSGVEDASITGNSGLQAVFNRDASGDAGTLVITGTISNDVTWNSDILVQPVAHDRAGNTTNVSPYHLHIGKLSDDKPVQLFSQQELKTVVNPNSISQSERNDIINSLKAKNSSLASFLSTFNPYMVDNDGRVVLTFKDGSTRIIDPAQVITYRPQRKSIYTEPGSSNTKEAFITIAKGQEYTIGPDLRKYFLLSNGQDIPNNAFTTINGSSIPSPQAISRLNAGIYTYNVDALNAYNHSSERLTIKVNVVDVNTLAENQRVYRSTTKNLSNDEITQVRNAFKDANPQLNLNDSDIRIENDEPLSNHPSRVRVTITKGELTKQFISTFDHMDFLKWINLRNDYTVTWTSQKLNGRGTDGGFEWSPDGKTIIYRYDATTGRRITGNDVLSLLRATPKHAGLRNHIEGQEKMLTESGSARGFKPVGYSKGNSIYSDEEHPFTYDGQPIQVLDIVDSNTGYSNSAVARSDYRHTSSNSTVISGDIPAMNGAAGFHLDKILKQNGTDNGIMGAIDKQQLYLTPYGAKSYIERLGQSMSSTDNVINIVFVPTDKVTPNIVLDDYNDHVVFSGETFRNTLTLTDNFGIKNVTVPNDSQIPMNVLNHSTLSGVAPNVSTPMSKQVKVKVTDGSDNETTAVFNVLIKPLKDKYSVMTTADESHPIRIANISNNASLSETDRQAIFNSLDISKSITNRNYVTDGSNEIRSREISNVHRSGNNANVEVTITYADNSRTSITVPVKHVIPNIRGIELFTVQGQPFPSGKGTNNNDFFVINNDQPLTDATVTWIGNGPDINSTTVGVPQILRANILFDGETTPIEKEAHYRAVKAKPKRVYQTTINGNFLSSNEGLSSNVGSFVEGIANYLPSGTNFDWAPGSGQPLSNSPGIFTETINVIYPNGQVDPVNVLFKVKPTTPSIDTLSTKYKADLFGQSIKVNNVPNNAQVKLYTEDGREMSNTTMTRNRDGSVSITIPGVLPLGNIKAKSIITVDHVTITEQNNSGSVVNSTRSESIESDLSASSPVTKQLEAVDGGLKFVKGDNIDLNNPRTYINSNSDIIRVEWEQNANQWKNTIGTTTKRAIVTLSNGETRTVSIPVTIYAPATAKAPQRDVVGHALTYGDDATNYVTFENNYMNGATVTWKNNNAPSNNIAGVQSLTAEVRYNGINHVYNVPVKVYEYKYKFKKSEYSTIVGTSFEGNGNINNYVALENANGLPTDGFHFVWTQNTTASHSDQWSNLAHPNQAFKKEARFEVLDNQNHVFFTSDPAIFKVTNAVPNPATVTQNDVGDVVISPGVGKNLGVNAGNIIVNPDRITVKKGNQVIGTFVKNNTGKWAKASDSINTPGLSVSPDGNEIIYDKMSVPNDTLINTESTTGNGELTSEAATSATYKVKPATPSNTTFAFKQNGEFEVIPNNANTSTTKNPTDKVKISYVEKMGNSAEQSRELIVTKNNQNRWSMNNQPDYVIFDSITGKVTFKANSLKPHVLINTESIAGNDDNFSHNTVGVVGPDHHDVIIHEIVKEPGERVSNEELNNAISVDNKDHANVNEGVSLPTNLQSDTTQAVPTRITYRDGSIEIVNVPIRTHADKSSIRNTLPKLDAQGDTNGKTPSSVSAYNNEMQHLHDEIEAVRRRANEVLSNDRATNTDVANVTNNINDVSLKIQHAISLLQNKADNSALVEAKRQLDEATAEQDPTPGMTQVTSDNYRAKKAEAERISSEAQGVINNGDATAEEIRDEKVKVEKALTALNQAKDDLRADKTELQHKLPELDQRGIIEG

SEQ ID NO: 43031 - protein, 418 aa, Staphylococcus hyicus
MENKQFFSIRKFSVGVGSCLIASSLLLGSTTLAAEETSPVDAQQNAFYEIVNLPNLTDEQRNGYIQSLKDDPSVSANILQQAQATNANQAPAQPAPNFDAAQQNAFYEIVNLPNLTDEQRNGYIQSLKDDPSVSADILQQAQATNANQAPAQPAPNFDAAQQNAFYEILNLPYLSEEQRNGFIQSLKDDPSVSNDILAEAKKANDAQAPQPENNFNEAQQNAFYEILHLPYLTEEQRNGFIQSLKDDPSVSNDILAEAKKLNDSQAPQTEDNNNSSEDNSNGKTTPQDKNDNSKVDSTDKNNDTSTTPKQDKASTTQTGKDSYVVQKGDTLESIAKKRGTSVDQLVKDNQLADKNMILPGQKLVVNHVESPKNASSKALKTLPETGSTGHEDLFGTTLAGGLSLALGALLLGRHRKTN

SEQ ID NO: 43032 - protein, 641 aa, Staphylococcus hyicus
MKETKHQHTFSIRKSAYGAASVMVASCIFVIGGGVAEANDSTTQTTTPLEVAQTSQQETHTHQTPVTSLHTATPEHVDDSKEATPLPEKAESPKTEVTVQPSSHTQEVPALHKKTQQQPAYKDKTVPESTIASKSVESNKATENEMSPVEHHASNVEKREDRLETNETTPPSVDREFSHKIINNTHVNPKTDGQTNVNVDTKTIDTVSPKDDRIDTAQPKQVDVPKENTTAQNKFTSQASDKKPTVKAAPEAVQNPENPKNKDPFVFVHGFTGFVGEVAAKGENHWGGTKANLRNHLRKAGYETYEASVSALASNHERAVELYYYLKGGRVDYGAAHSEKYGHERYGKTYEGVLKDWKPGHPVHFIGHSMGGQTIRLLEHYLRFGDKAEIAYQQQHGGIISELFKGGQDNMVTSITTIATPHNGTHASDDIGNTPTIRNILYSFAQMSSHLGTIDFGMDHWGFKRKDGESLTDYNKRIAESKIWDSEDTGLYDLTREGAEKINQKTELNPNIYYKTYTGVATHETQLGKHIADLGMEFTKILTGNYIGSVDDILWRPNDGLVSEISSQHPSDEKNISVDENSELHKGTWQVMPTMKGWDHSDFIGNDALDTKHSAIELTNFYHSISDYLMRIEKAESTKNA

SEQ ID NO: 43033 - protein, 169 aa, Staphylococcus hyicus
MKKITTGLIIVVAAIIVLSIQFMTESGPFKSAGLSNANEQTYKVIRVIDGDTIIVDKDGKQQNLRMIGVDTPETVKPNTPVQPYGKEASDFTKRHLTNQKVRLEYDKQEKDRYGRTLAYVWLGKEMFNEKLAKEGLARAKFYRPNYKYQERIEQAQKQAQKLKKNIWSN

SEQ ID NO: 43034 - protein, 438 aa, Staphylococcus hyicus
MINKKKLVTSLVTSSLLATFTLGSFADAHTYIINNEDINKNAQESSIGTLKQNNFKQSTIDSMKPRNLQSFQEDKVFKAPKEKTPITERARKSENALSNSKLNDVRSFTTVNMRTNENERTAAKLKYNGKNTNVWVADNYITDKQAKNIGEEFDNKIDPLVKEKFGEPSDVDHDGKVNILVYDIKDDFETTGSYTGGYFHPRDLYDVPHSNKAEVFYMDTYPSMGTDKNNLNEKKVYSTLAHEYQHMVNANQKLLKEQKEDGMDVWLDEAFAMASEHMYLQKPLDHRIEYYNNSTSIANGHSLIKWNHRGDVLSNYALSYLFSQYLSAQSDNGDKIFKEILQDPANTSEALENAIHKHVDPKMSLGEFMTNFRVALEKKEATGLHGFNGAPGLNSISPKPVRELPQTLAPQGSVMFETTSPIKVPKDKDEKVNYVKVK

SEQ ID NO: 43035 - protein, 3278 aa, Staphylococcus hyicus
MGNKQVFLPNKLNKYSIRKFTVGTASLLVGATLVFGIGSETQAAELDTITKEDVKSQDKGEALDIKNIKKSEKDVTTEDDNNAQVQNSTQTVDKSENSNDIAVESTNDSVKTDETKETSENKSAQDDDNIKEDSNTQEASTNTSSQSSEDPQTKKDTNETSETAIDEGASTKEQNNKEDSNTQEASTNTSSQSSEDPQTKKEQPDKSSNSIKEPDKQQEEVAKEEKAITEIADKNKELELKNNKTDKNEESELESNLSSSENKKDTVESFLNSQLSDSETKKIMENANIAYDKATDEEINTEILRASLIEMANNKKKTETLATPQRTMFRAMATPTALRAAVNQDEELQKSLGYTDNYTFASMLFDPGKLDSDDALNSNIIPFDLHSYMSGANSGNRYKIDLKLDPIIAEHVTKISANPSGRNKPVEFVRIKDENGNLTDTWEVNFIRANDGLFGGAEILSQYTAKNGKIELDDTVGNIISSAGDLSNNKLNYQVFVRDSRENKIVRTSESSGYFLTKADDDLVNLENNVSTENNNAFKASSGSATYNEDVGEFGGILIDQQIMKNGIFSYSKTKANQWAYNYQIDKDLLPYIEGVELHQYDYKGLNGFDKNYDAKNKVADLTIDEVGNGTITSDNLNKLIEFNNALPETVGVRVVLKLNQSVNNILTKDAKYDSEGNLIRETTKQKEDFTFAGYLTDSKGALINNTLGTSTLALQDYDKDGLLDRYERQLSLSDAENEDTDGDGKNDGDEVVNYKTSPLVGKPQAADITTEDTVVSGSGPLKEGAATQTAKVINAEGTTVGTATVNSDGTFSVSIPNSPEGTYTIAIDSPNYDNDEVNIFEIVDNSKLPAPSINPVDDNDQQIVVNGTSGSTVTVTDSNNNVLGTVTIPADDTSAAINVDTPLEAGTVLTSTASKDGKTSDVSDQITVTDATAPDAPTLDKVNTDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSEPSSTNVTDTTAPDAPTVNDVTSDATQVTGQAEPGSTVTVTFPDGTTATGTADDQGNYTIDIPSNVDLNGGEELQVTATDKDGNTSESTNTTIIDSDDNSDNGNNSGTGDNSDSDNNSDSGDNSNAGDNSDSNNNSNNEDNSSPNKDSINQDSNVNSNDSKHDKQNELPETGEKEVSNGTLFGTLFAGLGSLLLFTKRRRKENDKK

SEQ ID NO: 43036 - protein, 120 aa, Staphylococcus intermedius
GVPNYEGNHLDNHKSQTIYVKVFENSKHIITFEIQADKKLVTAQELDAKARKFLIDKLNLYEFKGSPYETGYIKFIENDDKSFWYDLMPPPGNNFNQSKYLTMYSDNKTVESKDIKIEVH

SEQ ID NO: 43037 - protein, 239 aa, Staphylococcus intermedius
ESQPDPMPDDLHKSSEFTGTMGNMKCLYDDYYVSATKVKSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLIRVYENKRNTISFDVQTDKKSVTAQELDIKARNFLINKKNLYEFNSSPYETGYIKFIESNDNTFWYDMMPAPGDKFDQSKYLMIYSDNKTVDSKSVKIEVHLTTKNG

SEQ ID NO: 43038 - protein, 168 aa, Staphylococcus intermedius
MKKITTGVLILAIAIVVLIFQYINGDGPFKKSSTDVRGESYLVKRVIDGDTIIIDKDGQDERVRLIGVDTPETVKPNTPVQPYGKAASNFTKKHLTNQRVRLEYDREPKDKYGRTLAYVWLGDEMFNVKLAKEGLARAKFYPPNDKYRILIEQAQKEAQKKQLNIWER

SEQ ID NO: 43039 - protein, 310 aa, Staphylococcus intermedius
MVKNKLLAATLSISLILPLITPYSEEAKAANTIEEIGEGAQIIKRTEDVSSRKWGVTQNIQFDFVKDPKYNKDALIIKMQGFIKSRTSFTDVKGKGYESTKRILWPFQYNIALKTNDPNVFLINYLPKNKIESIDVSQTLGYNVGGNFQSAPLLGGKGEFNYSKKISYTQKNYISEVAQQNSKNIRWEVKANSFNTENGQVSAYDRHLFVRSPIGPNARDFFVPNDELPPLIQSGFNPSFIATVSHEKDKGDTSEFEIAYGRNLDITYATFFPRTGIFAERRHNALMNRNLVTKYEVNWKTHEIKVKGHN

SEQ ID NO: 43040 - protein, 326 aa, Staphylococcus intermedius
MKISKVIKAATATSVALMLFSNPVYAANQITPVSEKKVDDKITLYKTTATADSDNLNISQLLTFNFIKDKSYDKDTLVLKAAGNINSGYKSPNPNDYIYSSFYWGAKYNVSISAESKGAVNVVDYAPKNQNEEFQVQNTLGYSFGGDISISKGLSGGLNGSESFSETINYKQESYRTTIDKHTDNKTIGWGVEAHKIMNAGWGPYGRDSFHDLYGNELFLGGRQSKLNAGQNFLPTRQMPLLARGNFNPEFLSVLSHKPNGAKTSKIKVTYQREMDEYTNYWNGFHWMGTNYKNQNNATFTSFYEIDWDQHTVKLIKTHSDEKNPS

SEQ ID NO: 43041 - protein, 25 aa, Staphylococcus intermedius
MAADIISTIVEFVKLIAETVAKFIK

SEQ ID NO: 43042 - protein, 25 aa, Staphylococcus intermedius
MAGDIISTIVDFIKLIAETVKKFTK

SEQ ID NO: 43043 - protein, 153 aa, Staphylococcus intermedius
ATQNIQFDFVNDPKYNKDALIIKMQGFIKSRTSFTDVKGKGYEAVKRMLWPFQYNIALKANDPNVSLINYLPKNKIETIDVSQTLGYTIGGNFQSAPSISGRGAFNYAKKISYNQQNFISEVAQQNSRNIKWEVRANAFQSEDGPISAYANHL

SEQ ID NO: 43044 - protein, 86 aa, Staphylococcus intermedius
VNLWLHGKQTSVPLDTVRTYKKEVTVQELDLKARHYLHEKYNLYNPDAFGGKIQRGLIVFETSRKHSASYDLYAAEGKGADTILRI

SEQ ID NO: 43045 - protein, 264 aa, Staphylococcus intermedius
MNKKRFVISLLFSITILFVISSSTALADHTLDPTPDQLHKSSEFKGLMGNVKYLYDRNFISESNVKSIDSLLAHDLIFCIRESEIKEYGLVKTEFASKELAQKYRNKQVDIFGANYYVNCYFSGKEKGNEEDNGKTCMYGGVTNYEGNHLDNHKSQTIYVKVFENSKHIITFEIQADKKLVTAQELDAKARKFLIDKLNLYEFKGSPYETGYIKFIENDDKSFWYDLMPPPGNNFNQSKYLTMYSDNKTVESEDIKIEVHLTKK

SEQ ID NO: 43046 - protein, 2060 aa, Staphylococcus lugdunensis
MKRKKSKQKDYFSNVQNKYSIRKFSVGITSILIGASVIFGANSEAHAAEIKSDDNTQKVVNKEYSDGISQEQQDKSLNLAQDKEKSNNVNKNKVTDVGTSDVLKDTKTAHENVQQQDNVASKEETTKKTPSAIDKNNTSAQSEVVTSSDATKTSTALNQVDRNQLSSQSTSERPKKRVKRDVGTDDKQLVGEFVFSGTNSNERRYNLTSDIVSNRRVTSTSFSYSASGHGTIDNGKLVYEAPKKFIISEPTFSKSEFVTNKTNLSDNETWRYQFDLRPLSGTSAGQINISQVIGGMIWTGPGEGDVVTSTMKMYQGDTLVDTKQVNATFDHIKGGLYIDRGQEKPTSIWRITRKSAAAQSPTIGVIKEDGTISEKTDNYRYQVPLPRDNWFLENRDDAVSPHYYSRYTDFKYNILNIPSWLELDPDAKGNRFWTQDESGIHLHLNEGDILPYNGYTPVLKLKKSALTPELLAKFKTDGFIKVNLDWQTIGRLPNGQDYIQNVPDPEGIKFKMINEAGTATSNVYFMNFRLQEPSHLFSKADHKNEVFRVQKYIYDRDQSNKYAPTYMHSIQLPSGQEGDYFTTFKLSLPRINYNNGSSDKNADKGIILKAPFILYGVNADGSTTKLNEWTSINNTNNTYGLGDKKYNHLILQTPIIRDTVSPDSEAEKDIYGWEADITYAVDDQRWETAAKDDDVTQMQNGIIINQVAENTLQAASSVPTRALTGNELQPAYSYIHTKDAFKHTLTDVDVRNTNSGLGNVLNYNEKANVIVKADTKDYMKYLSTDPLDNSSDISVDKLDHINHVYLSLSAPDDTAIGNVRAWTNNELIRTSTVWNPSLYETTPSNVLKTRPVLNPIKVIKNYKNSGRTLYIYEAPEGYKWNQSVKNSITERSSITQNTPEITFDIYNRGTLPTGTYSIRYATIWDENSEIVRPTEEQSLSHNNLELSYVITEDLSGNKKFVSVIDVPFKIALAKEYASTLTIGKDASNSFDKSQVDVNLGESVNLQTNTANFTNSEGIIKEIIVTIPKDNIKTNLTALIPDTEKYRVVYTTDTDVRNGVYNSNPTDLTKVTAVKYVFDEPLVLTNGQSFQTNMRVTVPEDAPILTKAHSQIFTKGLDNTWLSGNKVELETEDNRGDLVVKYTNESGNTIQNSLTSKGKKNTEYNVSVPQMIDRLNRHYKFVRVDNQLDPTTGHYAKGQTKIVNLIYVEVFEGSVIADYKTTDGEVLSPLVTVVNSQIEGTEYTATPATIPDRVTFETTDDGKVKKTISYHLISTPENQSGTVVGKQTIEVHYVYEPITTYEQIPNDAPQETPVALEVTRYVDSEGNEVQETEEGTHDAPGIIADKWQYTGQTAAENGITTHVYQRIQSEIPNEAPQETPVALEVTCYVDSEGNEVQETEEGTHDAPGIIGDKWQYTGQTTTEDGITTHIYQRIQSEIPNEAPQETPVALEVTRYVDSEGNEVQETEEGTHQPPSIIGDKWQYTGQTTTADGITTYVYERIQSEIPNEAPKETPIQLEVTRYVDGEGNEVQETEEGTHHAPGIIGDKWQYTGQTTTESGITTHVYERIQSEIPNEAPQETPVQLEVTRYVNSEGNEVQETEEGTHQPPGIIGDKWQYTGQTTTADGITTYVYERIQSEIPNEAPKETPVQLEVTRYVDTDGNEVQETEEGTHQPPGIIGDKWQYTGRVTEKDGITTYVYERIQSAIPNEAPQETPVQLEVTRYVDITGNEVQETEEGTHQPRYIIGDKWRYSGVTVTENGITKHVYERIQSKVPNDAPQETPVQLEVTRYVDPEGNEIQETTEGKHQPPGIIGDRWQYTGKVTEKDGIITYVYERIQSEIPNNPPQETPVELEVTRYVDGEGNEVQETTEGKHQPPSIIGDRWQYTGKVTEKDGITTYVYERIQSKVPNDAPRVDIDELKITIYVDTNGREIVPSRKGQLPPEQFIGQDWQYTGHKIEKDGITTYIYKKVENAVPAKQLKKTKHNTQSESQFKHTPQVKQQLVKYHNVKEQRSIEKSEHTDMHVSELPETGETANKNGLIGGLLIAIGAFFVTKRKKENTK

SEQ ID NO: 43047 - protein, 881 aa, Staphylococcus lugdunensis
MKLTKKEKFSIRKHKFGVSSILVGSIIGLTMLMTKEAEAEEVERNLSKQQIQHNNDATGDTQDDNNYNNEISNQEATTQNKQITQSDNVNSEAQAINEISDSHRTVNKATEALDNNSTLNTSTDVSPATKQDTTTSNQTTQENNDATTQTKTNYKQDGNNNVLSQVATNDNQSSNQPRNSHLNTSTVTYNNNHQVRRLAKVEATNTDNNVTQTSDISNKLSNVTATIEAADTIYPHKAEYVNLNYRFQAPDDVQAGDSIKITIPQALNLNGVTATAKAPNIMAGDQILATGTIDEEGNLIYTFTDYVTNKNNITGQISIPGYIDPKNVTHTGKVNLETSIGQTTAKKTVTVDYEKYGEFRNLSIKGTIDQIDKVNNTYRQTVYVNPSSDTVVDPYLRGGSIPGTNSNVIIDEQNTSIKVYKVKEKAHLTDSYYVDPSNYEDVTSDVKITFPEKGIYQINFNTEDDQINSPYVVVINGHVDPNSNGNLYLRSTLYGYDSNFTRVSMAWDNEVEYHAGSGNGDGIDKPVIPDQPGDSDSDAYSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSNSGSDSNVDSDSDSENDNVSVEVDNNSNQRGISTMKAQHQHHDSNNTTQKNTDKSLPKTGEQSEQTGFISSILLFLGGLLFLNRRRSKKEDK

SEQ ID NO: 43048 - protein, 291 aa, Staphylococcus lugdunensis
  strain HKU09-01
MNKIQSWLSKYKIKNKPTMIALISFILFLILLFLFLNHNDQKSDRITVVENSELRTGPNAAYPVIEKVDKGEGFTKINQTGKWIEVQNRQETKKGWIAGWHTSLNIKKDVSQSQEPLKGKTIVLDPGHGGSDQGASSRTNKKSLEKNYTLKSALELKTLLEKEGAHVKMTRSDDEYVKLEDRKASGDIFMSIHNDSLESSVANGATVYWYKDSQSKLAETLNASIQKKALLSNRGAKQENYQVLRQSKIPAVLLELGYISNPTDETMIRDQHHRHIVLEGVVDGLKQYFAS

SEQ ID NO: 43049 - protein, 701 aa, Staphylococcus lugdunensis
  strain HKU09-01
MKLTKKEKFSIRKHKFGVSSILVGSIIGLTMLMTKEAEAEEVERNLSKQQIQHNNDATGDTQDDNNYNNEISNQEATTQNKQITQSDNVNSEAQAINEISDSHRTVNKATEALDNNSTLNTSTDVSPATKQDTTTSNQTTQENNDATTQTKTNYKQDGNNNVLSQVATNDNQSSNQPRNSHLNTSTVTYNNNHQVRRLAKVEATNTDNNVTQTSDISNKLSNVTATIEAADTIYPHKAEYVNLNYRFQAPDDVQAGDSIKITIPQALNLNGVTATAKAPNIMAGDQILATGTIDEEGNLIYTFTDYVTNKNNITGQISIPGYIDPKNVTHTGKVNLETSIGQTTAKKTVTVDYEKYGEFRNLSIKGTIDQIDKVNNTYRQTVYVNPSSDTVVDPYLRGGSIPGTNSNVIIDEQNTSIKVYKVKEKAHLTDSYYVDPSNYEDVTSDVKITFPEKGIYQINFNTEDDQINSPYVVVINGHVDPNSNGNLYLRSTLYGYDSNFTRVSMAWDNEVEYHAGSGNGDGIDKPVIPDQPGDSDSDADSDSDADSDSDADSDSDADSDSDADSDSDADSDSDADSDSDADSDSDADSDSDADSDSDADSDSDADSDSNSGSDSNVDSDSDSENDNVSVEVDNNSNQRGISIMKAQHQHYDSNNTTQKNTDKSLPKTGEQSEQTGFISSILLFLGGLLFLNRRRSKKEDK

SEQ ID NO: 43050 - protein, 437 aa, Staphylococcus lugdunensis
  strain HKU09-01
MPIITDVYAREVLDSRGNPTVEVEVLTESGAFGRALVPSGASTGEHEAVELRDGDKSRYGGKGVTKAVENVNEIIAPEIIEGEFSVLDQVSIDKMMIQLDGTPNKGKLGANAILGVSIAVARAAAELLGQPLYKYLGGFNGKQLPVPMMNIVNGGSHSDAPIAFQEFMILPVGAESFKEALRWGAEIFHNLKSILSERGLETAVGDEGGFAPKFDGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSRGIEEGIGNSILIKVNQIGTLTETFDAIEMAQKAGYTAVVSHRSGETEDTTIADIAVATNAGQIKTGSLSRTDRIAKYNQLLRIEDELYETAKFDGLKSFYNLDVSKK

SEQ ID NO: 43051 - protein, 328 aa, Staphylococcus lugdunensis
  strain HKU09-01
MYLDWQRKCIITTMVVLSSLLLVFSSITYASERNTEDSLKITTHNVYFLPTAIYPNWGQSQRADLISKADYIQGQDVVILNELFDHKASNRLLTNLKSQYPYQTPIVGQGTEGWQKTSGSYRKLKKVSGGVGIVSKWPIVQQEQHIYKNGCGADSVGNKGFAYIKINKNGKYQHIIGTHLQAEDPVCMKGKDQTIRQSQMEEIKQFIKDKNIPKDEPVYIGGDLNVIKGSAEYQKMSDNLNVSMPKQYEGNAYSWDTQTNGIANYNYPKLEPQHLDYILLDRDHAQPSSWHNHTHKVKSPEWSVKSWGKTYRYNDYSDHYPVSAYAAN

SEQ ID NO: 43052 - protein, 690 aa, Staphylococcus lugdunensis
  strain HKU09-01
MKNNHENNNARPNQHFSIRKFSIGAASITLGTCLFLNAEHQAQAAENAVEPAHSAVASENNTPAQSKPVAPTVETNEQPNADHTDKTVATTTTNDKSRAQANDKQTVTPATNVSNTTQPKAAPASTALTTNAVNPKSSTAVSNPAKQAVDQSIKDAVKDKTYTNKPHDTSNSRPVSFEMKNKDGDLQFYHYASTISPANVYFNKDKNKTTVELGLKTASTWKKFEVYENNKKLPIELVTYNPETDDAYIRFDVSNGTKELVIKSSTQIYNDPETNYDYTKMVFEQPIYNDESKFKTREDFETEALLADYNKAKTLERKIYELNRVKDQLPEKLRAQYSQKLEQLKKDLDQEVASAKVEFEHAPVKKVQITNSKSLDISVLQSDDDDLSTMDGFVEKPFELVEVDGKKYIKLTTTIDSIWKDFQVEGQRVMTIDKDTVNDKRTVLFPYVEGKEIYNSIVKVDFPTIGYSGQYHVRIKNNAISKKADAETPTTPNNKKEAKPDINQADTATSNNKKADKPIVKPADTTTDHKKVTKSVVTTTHAPANHKQMNKPTVSVASNTGHTKQTVVQQTAAHNHTHSNTSHQNVSTKTQISTLNVAKHSVHNQVQHNNQRSHHTQQQDVTKPLSHAQNNHTVQSQISHMHKTAAHPSPVAQHTLPATGQTTNHATLWASLVAILGGIMFLIRPKKKHQ

SEQ ID NO: 43053 - protein, 646 aa, Staphylococcus lugdunensis
  strain HKU09-01
MKKHQRIQTNKFGFIANHYSIRKFSVGTASIIVGSLLFLGNPAHAAEANTTQNEPATHQENKVETNIDPIIIDQPQNQAATTNQTPKTEQNHTQANKQQAKSNQAAAVTSDSKSQNDAQASPQQSSTSKQDAVKQQATQANTKAPAQPATQQTREAQPVVRSVKSATSETTEDFEFQVNKDKTKQKSTMNQYMNHPGKLVHANNKYYFEAELNHAKWWKSFEFYDENNNKLNTVVTKDDTSKNIKTIRVEVASGTQQLISKVHIIVPVINYDHEYTTQIAFAKPVPQPAKAQASKAQALDVQSTQKNAVKPETLAQAKNVARPSVMTLSAKKPASQQAKSAAVTQTAKYKVQKDKSTETSVMDGYMEHPGKFIKENGKTYFEVTLKNADWWKSFQFFTPQNKELTTTVVKHDKKADTKTIRVEVKPGMKQLISRVHIVVPAINYDNKYQTTLLFETPVPELTTAKPETPKTKPANKTNKAKTSTTKPTKANKENKANKTKKVDKAKNNAPKVVQPATTVNQHSKAAATHKTIKTSHVSTTVNHDATATQHHTPVVASTYKPAKDEVKAQATMAQPTTQQHVHLSQNKHEDKQHVAMTKPQPAQQSHMHSLPNTGQENATTSASIFGSLLALGGSILLFGRKRKEQR

SEQ ID NO: 43054 - protein, 198 aa, Staphylococcus lugdunensis
  strain HKU09-01
MKRLFSLLLISSLVLTACGSKSHSESNSSEKKSSESKSATDKSESVDSCLEKAKNKPTAKFKDNKFTSNKFDIEIKETKVVKPDKYADSKNPNLAIVYKVKNKSSEKITASTAFIEAFDVYNDTKNVQKRLETGFAEDSDLYKKYGEDMRNNINKDGEVTGVRFFEIKDDKKPITIEAKNPDGYTTKEIGKKIIKLEH

SEQ ID NO: 43055 - protein, 2886 aa, Staphylococcus lugdunensis
  strain HKU09-01
MKSKSNKNLGLSPIKQNKYSIRKFKLGAASVTVASLLIFGTAGVAKAAEVHGADKAQQAEHVANVAKSDTAKATEATPAASTQQNEVKTSEAPNTAKAVTDKEAITPTAAPKEDKVVSDKATTQDKKETRGYKANNTEPQKGTNAIANTGKHDPRNGQAIPGYGTSSFRDGGNTVSIDGGKITASGHVNVDDRVNTTTGISYDYTLNFKEGAFHEGDTFKIGIKELGEDTRLPKELKADDGTTFAIRDSYKSLYNNPNTNQIPFFSQRNPGTIDEKRSWHLQSRGTFLEGVYKFTKEVEKLKNLHFSFSNKDGLRFPEVTKDKRVTGAILVNDQVIASKDYTVVGQAISPAPVNLNKAVIDTSGDINIDKDGTVKSKWENLRLNTNGKTFTTNTTFTVTLPDTGMNSFEKVGDFNETGVMIVEVASNASNSVANENDVVLKAPKEDPSRIAKVRVESVQPNKLVFKLVSGQLDPNKVYVFLLKNMGVERKVNSTTLNYLSPDKSSISEQGATFEVTKDGQRLTDTYTTTAGVNWNVVGDRTKLNTGASLAFYDVTSRYIDGSGNLLISADPAVEHGLASVDEFNTHNPQPNFNEAQVGNPDNSHATITTTNGSNKKVTDITPPYLIKKDGKYYVFNQYLTKSNYYQNTRTSGTIEHSPVNVVAQYANAKFGTVSVGYEIKDSNEKLKADEVIRDGSAQLTNIVGNQYTVPSDKVPNTIEKDGILYVLSKVPADAPSNATGQIAETPTRVVYKYTNAYVSVTPENPGHPGQPIDPNNPSIVWPRYTDLASLTKSVTRTIKYVDAENTSKVLHAPVIQTVKFTRTPIVNVVNGRIVGYDEDGNGTIDTTSAENAWVPENSGATTWPEQTSPKANELTEQGYHETTTPSVAAVSVNASTISTEVLVKYQRQDKEKYEPTPGQINHDYGTPTTADEVKNSVKVPGYPTSVGIPTITVDNPNQIPNGQTPGTVVIPVTVTYPDGSKDKTTVTVVTGNPLKDAYEPSTKPINKPFGTPTTADEVKKAVTVPDYPSSKGTPEVTIDDQSKIPNGQTPGTYTVPVTVTYPDGSKDHANVTVNVGNPENSTYEPHVTPINKPFGTPTTADEVKKAVTVPDYPSSKGTPEVTIDDQSKIPNGQTPGTHNVPVTVTYPDGSKDHVNVPVNVGDPDSSRHEPKVTPITKDFGTPTTADDVTKAVIVPDYPSSKGTPTVTVDNPSTLPNGQTPGTYTVPATVTYPDGSKDHVNVPVTVKEQPDKDKYEPKVTPITKGFGTPTTADEVKKAVTVPDYPSSKGTPTVTVDNPSTLPNGQTPGTYTVPATVTYPDGSKDHVNVPVTVKEQPDKDKYEPKVTPITKDFGTPTTADEVKKAVTVPDYPSSKGTPVVTVDNPNTLPDGQTPGTHNVPVTVTYPDGTKDHVDVPVTVKEQPDKDKYEPKVTPVTKDFGTPTTADEVKKAVTVPDYPSSKGTPVVTVDNPSTLPNGQTPGTFTVPATVTYPDGTKDHVDVPVTVKEQPDKDKYEPTTKPITKSFGTPTTADEVQKAVTVPGFPSSKGTPVVTVDNPSTLPNGQTPGTYTVPVTVTYPDGTKDHTNVTVNVGDPDSGKYEPKVTPITKDFGTPTTTDDVTKAVTVPNYPSDKPAPKVSVDDPSTLPNGKTPGEYTVPATVTYPDGTKDHVNVPVKVGNPDSSKYEPKVTPITKDFGTPTTADEVQKAVTVPDYPSSKGTPVVTVDNPSTLPNGQTPGTHNVPVTVTYPDGSKTHVDVPVTVKEQPDKDKYEPKVTPVTKDFGTPTTADDVTKAVTVPDYPSSKGTPVVTVDNPSTLPDGRTPGTYTVPATVTYPDGTKDHVDVPVTVKEQPDKDKYEPKVTPVTKDFGTPTTADDVTKAVTVPDYPSSKGTPIVTVDNPSTLPNGKTPGEYTVPVTVTYPDGTKDHVNVPVKVGDPDSGKYEPKVTPITKDFGTPTTTDDVTKAVTVPDYPSSKGTPTVTVDNPSTLPNGQTPGTYTVPATVTYPDGSKDHVNVPVTVKEQPDKDKYEPKVTPVTKDFGTPTTADDVTKAVTVPDYPSSKGTPKVSVDNPSTLPNGQTPGTYTVPVTVTYPDGTKDHVDVPVTVKEQPDKDKYEPSTKAITKPFGTSTTADEVKKAVTVPNYPSNKPTPEVSVDDSSKIPDGNTTGTFTVPVTVTYPDGTKDHTNVTVNVGNPDSGNYPPKVTPITKDFGTPTTADDVTKAVTVPDYPSSKGTPTVTVDNPSTLPDGHTPGAHSVPVTVTYPDGSKTHVDVPVTVKEQPDKDKYEPSTKAITKPFGTPTTADEVKKAVTVPNYPSDKPAPKVSVDDPSTLPNGKTPGEYTVPVTVTYPDGSKDHVNVTVKVGDPDSGKYEPKVTPITKDFGTPTTADDVTKAVTVPNYPSDKPAPKVSVDDPSTLPHGKTPGEYTVPVTVTYPDGSKDHVNVTVKVGDPDSGKYEPKVTPITKDFGTPTTADDVTKAVTVPNYPSDKPAPKVSVDDPSTLPNGKTPGTYTIPVTVTYPDGSKDHVNVTVKVGDPDSGKYEPKVTPITKDFGTPTTTDDVTKAVTVPNYPSDKPAPKVSVDDPSTLPNGKTPGEYTVPVTVTYPDGSKDHVNVTVKVGDPDSGKYEPKVTPITKDFGTPTTTDDVTKAVTVPNYPSDKPAPKVSVDDPSTLPNGKTPGTYTIPVTVTYPDGSKDHVNVTVKVGDPDSGKYEPKVTPITKDFGTPTTADDVIKAVTVPNYPSDKPAPKVTVDNPSTLPNGKTPGTVYVPVTVTYPDGSKDHVTVSVTTRPNKPSESVQPVQPNEPVQPAKDATPLVDGNHVTVDTQNHAKTATNQSTLDNKHQAPAKASEQKSLPDTGQKETTNTTLFAGLFAALATAMFVSRKRRKDNK

SEQ ID NO: 43056 - protein, 2194 aa, Staphylococcus lugdunensis
  strain HKU09-01
MKRKKSKQKDYFSNVQNKYSIRKFSVGITSILIGASVIFGANSEAHTAEIKSDDNTQKVVNKEYSDGISQEQQDKSLNLAQDKEKSNNVNKNKVTDVGTSDVLKDTKTTHENVQQQDNVASKEETTKKTPSAIDKNNTSAQSEVVTSSDATKTSTALNQVDRNQLSSQSTSERPKKRVKRDVGTDDKQLVGEFVFSGTNSNERRYNLTSDIVSNRRVTSTSFSYSASGHGTIDNGKLVYEAPKKFIISEPTFSKSEFVTNKTNLSDNETWRYQFDLRPLSGTSAGQINISQVIGGMIWTGPGEGDVVTSTMKMYQGDTLVDTKQVNATFDHIKGGLYIDRGQEKPTSIWRITRKSAAAQSPTIGVIKEDGTISEKTDNYRYQVPLPRDNWFLENRDDAVSPHYYSRYTDFKYNILNIPSWLELDPDAKGNRFWTQDESGIHLHLNEGDILPYNGYTPVLKLKKSALTPELLAKFKTDGFIKVNLDWQTIGRLPNGQDYIQNVPDPEGIKFKMINEAGTATSNVYFMNFRLQEPSHLFSKADHKNEVFRVQKYIYDRDQSNKYAPTYMHSIQLPSGQEGDYFTTFKLSLPRINYNNGSSDKNADKGIVLKAPFILYGVNADGSTTKLNEWTSINNTNNTYGLGDKKYNHLILQTPIIRDTVSPDSEAEKDIYGWEADITYAVDDQRWETAAKDDDVTQMQNGIIINQVAENTLQAASSVPTRALTGNELQPAYSYIHTKDAFKHTLTDVDVRNTNSGLGNVLNYNEKANVIVKADTKDYMKYLSTDPLDNSSDISVDKLDHINHVYLSLSAPDDTAIGNVRVWTNNELIRTSTVWNPSLYETTPSNVLKNRPVLNPIKVIKNYKNSGRTLYIYEAPEGYKWNQSVKNSITERSSITQNTPEITFDIYNRGTLPTGTYSIRYATIWDENSEIVRPTEEQSLSHNNLELSDVITEDLSGNKKFVSVIDVPFKIALAKEYASTLTIGKDASNSFDKSQVDVNLGESVNLQTNTANFTNSEGIIKEIIVTIPKDNIKTNLTALIPDTEKYHVVYTTDTDVRNGVYNSNPTDLTKVTAVKYVFDEPLVLTNGQSFQTNMRVTVPEDAPILTKAHSQIFTKGLDNTWLSGNKVELETEDNRGDLVVKYTNESGNTIQNSLTSKGKKNTEYNVSVPQMIDRLNRHYKFVRVDNQLDPTTGHYAKGQTKIVNLIYVEVFEGSVIADYKTTDGEVLSPLVTVVNSQIEGTEYTATPATIPDRVTFETTDDGKVKKTISYHLISTPENQSGTVVGKQTIEVHYVYEPITTYEQIPNDAPQETPVALEVTRYVDSEGNEVQETEEGTHDAPGIIADKWQYTGQTAAENGITTHVYQRIQSEIPNEAPQETPVALEVTRYVDSEGNEVQETEEGTHDAPGIIGDKWQYTGQTAAENGITTHVYERIQSEIPNEAPQETPVALEVTRYVDGEGNEVQETEEGTHDAPGIIADKWQYTGQTAAENGITTHVYQRIQSEIPNEAPQETPVELEVTRYVDGEGNEVQETEEGTHDAPGIIGDKWQYTGQTTTESGITTHVYERIQSEIPNEAPQETPVALEVTRYVDSDGNEVQETEEGTHQPPGIIGDKWQYTGQTTTADGITTYVYERIQSEIPNEAPKETPVQLEVTRYVDSEGNEVQETEEGTHQPPSIIGDKWQYTGQTTTADGITTHVYERIQSEIPNEAPQETPVQLEVTRYVDTDGNEVQETEEGTHQPPGIIGDKWQYTGKVTEKDGITTYVYERIQSAIPNDAPQETPVQLEITRYVDGKDNEVQETTEGKHEPPGIIGDRWQYTGQTTTADGITTYVYERSQSEIPNEAPQETPVQLEVTRYVDITGNEVQETEEGTHQPRYIIGDKWRYSGVTVTENGITKHVYERIQSKVPNDAPQETPVQLEVTRYVDPEGNEVQETTEGKHQPPGIIGDRWQYTGKVTEKDGIITYVYERIQSEIPNNPPQEIPVQLEVTRYVDPEGNEVQETTEGKHQPPSIIGDRWQYTGKVTEKDSITTYVYERIQSKVPNDAPRVDIDELKITIYVDTNGREIVPSRKGQLPPEQFIGQDWQYTGHKIEKDGITTYIYKKVENAVPAKQLKKTKHNTQSESQFKHTPQVKQQLVKYHNVKEQRSIEKSEHTDMHVSELPETGETANKNGLIGGLLIAIGAFFVTKRKKENTK

SEQ ID NO: 43057 - protein, 3799 aa, Staphylococcus lugdunensis
  strain HKU09-01
MKKGVSVINPEEKRQQLHSIRKFKVGTASILIGVTLIFGVPKVAYAEEMQAIQSNKQANDSSEETKSNNKQQNNLHGQTTEEQQNISTITETSVDNSKALNTADSSTSEQQDNDITTDATTKSIQSNENVIHQNTTNDAKNEKSNANIIKSKNETTTNENINPQNSVKENLTAKFKNTTETTNQQAAQIQSTTQKSTSAQTTLKQSRKLVQEKSQQDTTVTSKNNSNNSDQNTTLSGVTPFTNSNGDKTNEEKVVTTQPITVKQRRALMVKSNYAADTSISDPKVIDYPTPKNSKYSYMLHELGYNATTVSDESSLRFAGITQNKNSNGSTITLNLTKWNSATTNLNNGKINLSFSQSKFFSQIESISFDGTNMITDNNGQNWYTPASNANLGLIGSVTNSPIIITLKNNQSLTSLGYSNTNPVYFTHTWTLNDGSIAPESIQNALITPTLNPKVPQSTQSSGFTTGRLINKIDISRTDNTIKSIHSFKPDENFLQTDYNWVLYVKEQIPKELMPYIDRGSINIYVSDIFGNPISSDRNVQGFVDDNGFIDSSKINEISIKDNNTTSHLNSARGSLDHNVFYGTLGQSRNYTISYKLKDGVTIEQLQRELSDRLTFSSWLETDYLDSRDNGSANNRLMGSYASSYVDLIDRVPPEKPVANNITTDDKAIIGTAEANTKINLAFSDGHILTGTVDSNGNFSVSIPSGFNLTGKETISITAIDKGLNVSQPTTITVTDTTPPSLEDINSQVVLINTAINNVKINATDNSGDPIKITISQLPNGVSYNSDTQEISGKPTQVGVYPITVTATDASGNVSTTSFAITARDITAPDVKPIENQTIEINTAISNILINATDDSGLPVNNTVSGLPDGVTFDSTTNTISGIPTTLGTYPIEVMSKDNENNVTKTKFTIFVQDTTSPVVNAIQSQTVEINTPINSIKIDAKDNSLGSVVNTVSGLPDGITFDSETNTISGTPTQTGTSKIVIISTDASGNQTVTNTTIVVRDTIKPVVNPISNQKKEVNTPIDDIKIVASDNSNQDVTIVVTGLPRGVIFDTTTNTISGSPKEVGKYEFKVTVEDNAKNSTETRFTIEVVDTTAPTVKGINDQTKEVNTAIDNIKIDASDNSGQAVTNTVNGLPEGVTFDPKTNTISGVATKVGIYPIVVTSTDNQGNKVDTTFTIKIVDTTAPTVKEISDQTKEVNTAIDEIVIDATDNSGQAVTNKVRGLPEGVTFNPTTNTISGVATKVGTYPIVVISTDAEGNNVETKFSIKVVDTTAPTVKEISDQTKEVNTEIDNIKIDAKDNSGQPVTNTVSGLPSGVTFDPTTNTISGIATKVGTYPIVVTSKDTDGNSVEIKFTIKVVDTTVPTVKGISDQTKEVNTAIDNIEIIATDNSGQPVTNTVSGLPSGVTFDPTTNTISGIATKVGTYPIVVTSTDTEGNSVETKFSIKVVDTTAPTVKEISDQTKEVNTAIDNIEISATDNSGEVVTNRVSGLPEGVTFDPLTNTISGIATKVGTYPIVVTSTDVEGNSIETKFTIKVVDTTVPTVKGISDQTKEVNTAIDDIEIRATDNSGQVVTNKVSGLPKGVTFDPRTSTISGVATKVGTYPIVVTSTDAEGNSVETKFSIKVVDTTAPTVKEISDQTKEVNTEIDNIKIDAKDNSGQEVTNTVRGLPSGVTFDPRTNTISGVATKVGTYPIIVTSTDAEGNSTETKFSIKVVDTTAPTVKGISDQTKEVNTAIDDIEIRATDNSGEVVTNRVSGLPEGVTFDSRTNTISGVATKVGTYPIVVISTDAEGNSVETKFIIKVVDTTAPTVKGISDQTKEVNTEIDNIEISATDNSGEVVTNKVSGLPEGVTFDPRTNTISGVATKVGTYPIVVISTDTEGNSVETKFSIKVVDTTAPTVKEISDQTKEVNTEIDNIKIDAKDNSGQEVTNTVRDLPSGVTFDPSTNTISGIAKKVGTYPIVVTSTDAEGNSIETKFSIKVVDTTAPTVKGISDQTKEVNTEIDNIEISATDNSGEVVTNKVSGLPEGVTFNPTTNTISGVATKVGTYPIVVTSTDAEGNSVETKFSIKVVDTTAPTVKEISDQTKEVNTEIDNIEISATDNSGEVVTNKVSGLPEGVTFNPTTNTISGVATKVGIYPIVVTSTDNQGNKVDTTFTIKIVDTTAPTVKEISDQTKEVNTAIDEIVIDATDNSGQAVTNKVSGLPEGVTFNPTTNTISGIATKVGTYPIVVTSTDAEGNSIETKFSIKVVDTTAPTVKGISDQTKEVNTEIDNIEISATDNSGQAVTNKVSGLPQGVTFDPSTNTISGVATKVGTYPIVVTSTDADGNSVEMKFNIKVVDTTAPTVKEISDQTKEVNTAIDDIEISATDNSGQPVTNTVSGLPEGVTFDPRTSTISGVATKVGTYPIVVTSIDGDGNRTDTKFNIKVVDTTAPTVKGISDQTKEVNTAIDDIEISATDNSGQAVTNKVSGLPQGVTFDPRTSTISGVATKVGTYPIVVISTDADGNSVEMKFNIKVVDTTAPTVKEISDQTKEVNTAIDNIEIRATDNSGQAVTNTVRGLPEGVTFDPRTNTISGVATKVGTYPIVVTSTDADGNSVETKFNIKVVDTTAPTVKEISDQTKEVNTEIDNIEISATDNSGQPVTNTVRGLPEGVAFDPRTSTISGVATKVGTYPIVVTSTDADGNSVEMKFNIKVVDTTAPTVKEISDQTKEVNTEIDNIKIDAKDNSGQAVTNTVRGLPNGVTFDPRTNTISGVVTKVGTYPIVVTSTDADGNSIETKFSIKVVDTTAPTVKGISDQTKEVNTSIDEIVIDATDNSGQTVTNTVSGLPSGVTFDSRTNTISGVATKVGTYPIVVTSTDAEGNSTDTKFIIKVVDTTAPTVKEISDQTKEVNTAIDSIKIDAKDNSGQAVTNKVSGLPNGVTFDSRTNTISGVVTKVGTYPIVVTSTDADGNSIETKFIIKVVDTTAPTVKGISNQTKEVNTEIDEIVIDATDNSGQTMTNTVSGLPEGITFDPSTNTISGVATKVGTYPIVITSTDADGNSVETKFNIKVVDTTAPTVKGISNQTKEVNTAIDDIEISAKDNSGQPVTTKVSGLPNGVTFDSRTNTISGVATKVGTYPIVVTSTDADGNRTETKFIIKVVDTTAPTVKEISDQTKEVNTEIDNIKIDARDNSGQAVTNTVRGLPEGVTFDPRTNTISGVATKVGTYPIVVTSTDVEGNSIETKFSIKVVDTTAPTVKEISDQTKEVNTAIDSIEIRATDNSGQAVTNKVSGLPQGVTFDPSTNTISGVATKVGTYPIVVTSTDADGNRTDTKFSIKVVDTTAPTVKGISDQTKEVNTAIDDIEISVTDNSGQAVTNKVSGLPQGVTFDSRTNTISGVATKVGTYPIVVTSTDAEGNSIETKFSIKVVDTTAPTVKGISDQTKEVNTEIDNIKIDARDNSGQAVTNTVNGLPEGVTFDSRTNTISGVVTKVGTYPIIVTSTDADGNSVETKFIIKVVDTTAPTVKEISNQTKEVNTAIDNIEIRATDNSGQPVTTKVSGLPEGVTFDSRTNIISGVATKVGTYPIVVTSTDADGNSVETKFIINVIDEDKLEIQPIPNQIVKINTHIKDVKIIITGGLGSTIISVSGLPKGLEFKSETLTISGIPKEPGRYDIIVTVIDSNSNQADVHFVIEVINDDNNKKPDKNSHIDDPEKPVIDNSHKNGIAIHGKTNSSKHVIIDLPSELTKTVNINNPGNYTIWVSGAHKMHKESYRIVERDKDNDIYVLPDTGNNSKSSTGIVATVLAMIGGILLLFKRRKNDEEK

SEQ ID NO: 43058 - protein, 1136 aa, Staphylococcus lugdunensis
  strain HKU09-01
MTNRKRNSSQRMDFIPNKLNKYSIRKFTVGTASILVGATLFLGHHEAEAAEKQQSISQNHSDEQESSQADTTVTTEQTTNNNVSSQTNATSPSTQDKTTIDHTENPSSTNQQITENQSLHAKDLQTSNQNNVSHKDTANKSTEKEARQHQNHKSTIQQQESSEKLVTAAQNASATNQAVSTNTNETHVQYADKKLSQIGVNHQTKEQVKASLVTKKAFKPRSKRDLDNTIVAEALKADITNPDYGVRTPATPVTAAASTSPTTRALSSNYRVRALAAATPTGKDVSDKIKFSNIDIAVEGRTAHTNASGQRELWVTSGDILSLKADYTVDNSVKSGDTFTIGYGQYIRPGGFSLPSSDTELRDANGAIIAKGKYDSNTNKTTYTFTNYVDQYDNIQGSFKIAATAKRENAINDKGSYNMDVKIGNVSFNKNIIVDYGDNKNNPLNASTLYRDPKTNQQYRIIYINEPGKTYKNVKYHSTTMNGKLIDGTDAIKVYKVNDPSAMVNSFAPDLTSSKVTDVTSSKTITYDNNRSTVNVSLGNLDGKTRYIIAEKVEPTTDNGNLSSTFSITNDDKNNPTIWAASTTQGSAGDNSTGSGQQTGKYSLGDIVWNDKNRNGIQDIGEEGIPNVYVTLKDANGNEIDRVTTDENGNYKFKNLKNGEYTLEYSTPNGGYSLTKADQSNNDAVDSDAQLVNGKYVAKATIQDDDNMTVDAGFYKSVYNIGDFVWNDTNKNGIQDDGEKGLAGVTVLLKDEQGRTIATTVTDKNGKYGFYELESGNYTVQFITPDGYILSPSKVGTDVTKDSNGDEVPIKLTENDYSNDLGLYKPDAPKLDDYEITVEDKSYENTVRVNTKLPKNTIQLAQQGKDGRDRVYYKQLGYHPDLTGKDASKLLQIDGYYFEEVRRDHIYQSQDAIFEYNLDNNTGVKNITYNPTTNTYTVTYQDGSTKELPGQQPKGLTINNSYINQNGDTIVEFSDGTTITIPKGKDGVDGKKGEDGKTPKIEQTPITDSSGKQIGVTITVKDGDGKVINTQKVLNGQDGAKGNPGEKGEKGDPGTKGDKGEKGDTGAAGRDGQNGQDGKSVIANTERGTKDGQEGAYIRIYEVNPDGSRGTMISETFIKDGVKGQDGKDGRSPSIQ

SEQ ID NO: 43059 - protein, 190 aa, Staphylococcus lugdunensis
  strain HKU09-01
MKQMVQIILSVFALFLVLTATSVCVTQADTMSQQDAITTAKQAMARSGGNPDLQNFNTVIDKGNYFKIKITLKTNDSVGTYKVYKNGQVEYKNGKFGVYNLLNPNQTYAASEIANTSTHMAQQEQQNNPVDCKKELNRYYVGNIKSTELPQQNASLPETGHTSNNIITLAFGILALMSGLALTFMRNSKH

SEQ ID NO: 43060 - protein, 233 aa, Staphylococcus lugdunensis
  strain HKU09-01
MKKTVLASSLAVTLGVTGYALTSGHEAHAAETTNYDQLANLAQHNPSELNAHPVKAGAYDFSFVKDGFRYTFTSNGQNFTWKYIYTGEADSQPSTQGYTEGSTQAVSSNAQASNTNVQAVSAPRSSYQTSTTSYSAPATSSYSSSVRLSNGNTAGATGSSAAAIMAQRTGVPASTWSAIIARESNGQANARNASGASGLFQTMPGWGSTATVNDQINAAVRAYKAQGLSAWGM

SEQ ID NO: 43061 - protein, 3232 aa, Staphylococcus lugdunensis
  strain HKU09-01
MKSNKKPAQFLNRHNNYSIRKFTIGTASILVGTTLIFGLSNEAHAQSNSSAKVSDKVATEQSASTSQEADSSQQTAASNAQNVQTAPEQDKATPTTEVNSNNNQTDSKHVAPQKEQNQTATQTESKKETAQTQAKTEEKAASDSKKASEDSDDKATSKETDENKTDDSVDTNSNITTPVYDTTRARAATSVPLASSLDSDASAAENAEPPAEFIDKYNKSTNRSQLVHDLLAESYSETDVRAIVNRLNIDFNKTDAKKAFQAIMYAGIQYAKEQTSLYTTYATIPGDGVNVNNTEIGSVAELKRSIYIDPNKGLTVNGQGYTSQGQSPANYTVHVQPNKRTNKMDFTVTWKVNPSASASGHDADLGGFNFGSGYNVPERINGRFNIYGGNTISNNLDMIKSPHPSYPAGYGLSSRPTITRYFVQRGGRVEYHFSVPVRDWNGDLSFNGKVLMFDNNVTLVGQGVMNPNSNDNYFYDEMNIQGDNNPDRHIITTDDTSEVENIPFQIEYVVSKDLPVGQQEVQREGQVGKRGTLYSIVKFNNQTIGRFVKETYNIPPVNKIIKIGIGAVNDSNISGPLPPILEPQLSGTNIVSGETSPNAAVTITVGGRNYQTTSDNSGRFNFQLPNYTLQEGDHISAVATVEGKTSKPGKIIIPRDGRTPNLTTSVQRGQDQNKPGSWVTITNATTGQQVSRFFVPDGLPGNDGRSITITNEYLDPSTGERVVQFSDGRTIRLPKGPKGDKGDTGAQGPAGRSITITSTTVDADGNTIVRFSDNTTLKIPKGPKGDKGDQGPAGKSITVKHISKDSQGNTTVQFSDNSSIIIPAGTPGRNGTSVGIRTITPQANGDTVVTFTDGKTMTIPKGAKGDRGEAGPKGADGHSITITSNTVEPNGDRKIVFSDHTTVVIPKGDKGDKGDNGTSIGITQIDTDAAGNKVVHFTDGKTMTVPKGQDGTSIGIKSITPQANGDKLVTFTDNRTMVIPKGDKGDKGDKGADGASPTVTATRTQHDGKDGVEITITPANGGTPIKTFVADGERGERGLQGINGVDGKSIRVSSSRDNQKHETTLTFYYDQDGDQAFDASKDIVVDTAVIKDGRTPTVDIKKILRGVSTFRTATATANPDKGHEVKFYYDNNNNGIFDEGDEEISSGFIADGKNGQNGRNGRQGTELISGITPPTDSDGLNGDTYIDTNTGDTYKKENGKWVPSGNIKGPKGDKGENGQNGRDGKDVLNGKVDPQSSQGKDGDKYINTVTGDVFVKSGGNWTNEGNIKGPKGDRGERGETGPKGDKGENGTSIGITTIDTDSAGNKVVRFTDGKTMTIPKGQDGTSIGIRTITPQTNGDTVVTFTDGKTMTIPKGAKGDKGDNGRDGTSIGITNIQTDAAGNNIVHFTDGKTMTVPKGQNGTSIGIRTITPQANGDIVVTFTDGKTMTIPKGAKGDKGDVGARGADGRSITITSNTEQPNGDRKLVFSDNTTVIIPKGAKGDKGDKGDNGTSIGITTIDTDTVGNKVVHFTDGKTMTVPKGQDGQSVGVKTITTATNGDTVVTFTDGKTMTIPKGAKGDKGDVGARGADGRSITITSNTEEPNGDRKLVFSDNTTVIIPKGAKGDKGDVGAKGADGHSITITSNTVEPNGNRKLVFSDNTTVVIPKGDKGDRGENGQNGTSISITSTGTDTAGNTVVHFSDGKSVTIPKGQNGTSIGIRTITPQANGDTVVTFTDGKTMTIPKGAKGDKGDVGAKGADGRSITITSNTEEPNGDRKLVFSDNTTVVIPKGVKGDKGENGTSISITSIDTDTTGNKVVHFSDGKTLTVPKGQDGTSIGIKSITTSANGDKVVTFTDNQVLTIPKGEKGDRGDNGQDGHSITITRTETDATGNTIIHFSDGKNVTVPKGQNGTSVTIQNIAKQPNGDTVVTFSDGKSITIPKGDKGDAGVKGADGHSITITGNTQEANGDRKLTFSDNTTVVIPKGDKGDKGDNGQNGTSVSITTIDTDSTGNKVVHFSDGKTLTVPKGQDGTSIGIKSITTSANGDKVVTFTDNQVLTIPKGEKGDRGDNGHDGQNGRDGASITITRTETDAAGNTVIHFSDGKNVTVPKGQNGTSVTIQNIAKQPNGDTLVTFSDGKSITVPKGDKGDAGVKGADGHSITITSNTEEPNGDRKLVFSDNTTVVIPKGAKGDKGENGTSIGISRTEVDGSGNTVVHFTDGKVITIPKGQNGTSVGIATITTSSTGDKVVTFTDGKTLTIPKGDKGDRGDNGHDGTSITITRTETDGNGNTVIHFSDGKNVTVPKGQNGTSVTIQNVTKQPNGDTVVTFSDGKTITIPKGDKGQDGKSITIISNTIEPNGDRKVVFSDNTSIIVPKGAKGDKGQDGTSVTLTNTTTDGDGNTVIHFSDGKTVTVPKGAKGDKGQDGTSVTVTDTTTDGAGNTVIHFSDGKTVTVPKGHDGQNGHDGTSVTVTNTTTDGDGNTVIHFSDGKTVTVPKGAKGDKGQDGTSVTITRTETDQAGNTVVHFSDGHSITVPKGQDGQNGTSITVTNTELDKDGNTVIHFSDGKTVTVPKGAKGDKGQDGTSITITRTETDQAGNTVVHFSDGHSITVPKGQDGHSIGIQEITKNAQGETVVTFTDNHSITIPKGEKGDKGQDGTSVTVTNTTTDGAGNTVIHFSDGKTVTVPKGAKGDKGQDGTSITVTNTTTDGAGNTVIHFSDGKTITVPKGQDGHSVSIQEITKDAQGGTIVKFTDGHSITIPKGDKGDRGEKGQDGQSITIVSQRVTKEGNTIVEFSDGHTITVPRGQDGHSVTVKESHKDQSGNTVVVFSDGNTITIEKGRDGRDGQDGKSITIVSQRVTKEGNTIVEFSDGNSITIPRGQDGHSVTVKESHQDQSGNTVVVFSDGNTITIEKGRDGRDGRDGRDGRDGNNGQNGYNGNNGYNGQNGYNGQNGYNGKDGQSIHIVSQKLTKDGNTIIEFSDGHTITIPGGQNGHSVTVKDIQKDQSGNTIIIFSDGRKVVIEASKQIQKQDVKPTPSAVKHYYIDQDKNTVIILADGREVCVPCIQGTRATIKYYYIDQAGNVHIDFNNHPSIVIPRKPIEITKTHQHTNHQSYNHQHQDFNGGYNNYHNHYKGQHDFNGQHSHHGVNNFVGHQGNAGHQHYSHYENYTHSQYDHGQAHANYAHQAVQHQAYNRHVSYHGYGYTMTEAMAQYRDVVTKRYALPETGETTSLSLAYLMTLVGSILLLSAFRRKNVK

SEQ ID NO: 43062 - protein, 277 aa, Staphylococcus lugdunensis
  strain HKU09-01
MKFYQQQRFGIRKFAIGIGSVALATVVFLGANQDAYASETSRTATEQNQSQAQHQANTQNQHTSGKHTSEVDITSPYGKTTDIIEKNNSNQNSSSHSKTEIILGSTDGEWLINDITIINSETHHTSQNNHSSHNIKTEKQSTSKKIQHTGSSVKTVSQQRTSQSRLTKQAVQHQSQKQNVEKHSKIVNPSTAAVNVEQPFNPSQHNELNHTHQTLINQTKKPTVTHATSSNMTVTAPITHKALPNTGKEETPEHSMALASILAVLGSALFMRRRKHI

SEQ ID NO: 43063 - protein, 235 aa, Staphylococcus lugdunensis
  strain HKU09-01
MKKTIIASSLAVGLGLVAGNAGHDADASELNVNTKAELAQLAQSNDQSLNEKPVQSGAYDFTFNYEGTTYHFASDGTYFEWQYYPSNGAADDTTMNSQAQQGTMSSSQGAATQQSTSAQPAQTEQAPQSESTQQPQTQATSHSQSSSASQASSHSSVNVNSHLKAIAQRESGGDIHAVNPSSGAAGKYQFMQSTWDHVAPSEYKGVSPANAPEHVQDAAAQKLYDTEGAGHWTTA

SEQ ID NO: 43064 - protein, 329 aa, Staphylococcus lugdunensis
  strain N920143
MMYLDWQRKCIITTMVVLSSLLLVFSSITYASERNTEDSLKITTHNVYFLPTAIYPNWGQSQRADLISKADYIQGQDVVILNELFDHKASNRLLTNLKSQYPYQTPIVGQGTEGWQKTSGSYRKLKKVSGGVGIVSKWPIVQQEQHIYKNGCGADSVGNKGFAYIKINKNGKYQHIIGTHLQAEDPVCMKGKDQTIRQSQMEEIKQFIKDKNIPKDEPVYIGGDLNVIKGSAEYQKMSDNLNVSMPKQYEGNAYSWDTQTNGIANYNYPKLEPQHLDYILLDRDHAQPSSWHNHTHKVKSPEWSVKSWGKTYRYNDYSDHYPVSAYAAN

SEQ ID NO: 43065 - protein, 690 aa, Staphylococcus lugdunensis; identical to SEQ ID NO: 43052
  strain N920143

SEQ ID NO: 43066 - protein, 646 aa, Staphylococcus lugdunensis; identical to SEQ ID NO: 43053
  strain N920143

SEQ ID NO: 43067 - protein, 437 aa, Staphylococcus lugdunensis; identical to SEQ ID NO: 43050
  strain N920143

SEQ ID NO: 43068 - protein, 198 aa, Staphylococcus lugdunensis; identical to SEQ ID NO: 43054
  strain N920143

SEQ ID NO: 43069 - protein, 291 aa, Staphylococcus lugdunensis; identical to SEQ ID NO: 43048
  strain N920143

SEQ ID NO: 43070 - protein, 1930 aa, Staphylococcus lugdunensis
  strain N920143
MKKGVSVINPEEKRQQLHSIRKFKVGTASILIGVTLIFGVPKVAYAEEMQAIQSNKQANDSSEETKSNNKQQNNLHGQTTEEQQNISTITETSVDNSKALNTADSSTSEQQDNDITTDATTKSIQSNENVIHQNTTNDAKNEKSNANIIKSKNETTTNENINPQNSVKENLTAKFKNTTETTNQQAAQIQSTTQKSTSAQTTLKQSRKLVQEKSQQDTTVTSKNNSNNSDQNTTLSGVTPFTNSNGDKTNEEKVVTTQPITVKQRRALMVKSNYAADTSISDPKVIDYPTPKNSKYSYMLHELGYNATTVSDESSLRFAGITQNKNSNGSTITLNLTKWNSATTNLNNGKINLSFSQSKFFSQIESISFDGTNMITDNNGQNWYTPASNANLGLIGSVTNSPIIITLKNNQSLTSLGYSNTNPVYFTHTWTLNDGSIAPESIQNALITPTLNPKVPQSTQSSGFTTGRLINKIDISRTDNTIKSIHSFKPDENFLQTDYNWVLYVKEQIPKELMPYIDRGSINIYVSDIFGNPISSDRNVQGFVDDNGFIDSSKINEISIKDNNTTSHLNSARGSLDHNVFYGTLGQSRNYTISYKLKDGVTIEQLQRELSDRLTFSSWLETDYLDSRDNGSANNRLMGSYASSYVDLIDRVPPEKPVANNITTDDKAIIGTAEANTKINLAFSDGHILTGTVDSNGNFSVSIPSGFNLTGKETISITAIDKGLNVSQPTTITVTDTTPPSLEDINSQVVLINTAINNVKINATDNSGDPIKITISQLPNGVSYNSDTQEISGKPTQVGVYPITVTATDASGNVSTTSFAITARDITAPDVKPIENQTIEINTAISNILINATDDSGLPVNNTVSGLPDGVTFDSTTNTISGIPTTLGTYPIEVMSKDNENNVTKTKFTIFVQDTTSPVVNAIQSQTVEINTPINSIKIDAKDNSLGSVVNTVSGLPDGITFDSETNTISGTPTQTGTSKIVIISTDASGNQTVTNTTIVVRDTIKPVVNPISNQKKEVNTPIDDIKIVASDNSNQDVTIVVTGLPRGVIFDTTTNTISGSPKEVGKYEFKVTVEDNAKNSTETRFTIEAVDTTAPTVKGINDQTKEVNTAIDNIKIDASDNSGQAVTNTVNGLPEGVTFDPKTNTISGVATKVGIYPIVVTSTDNQGNKVDTTFTIKIVDTTAPTVKEISDQTKEVNTAIDEIVIDATDNSGQAVTNKVRGLPEGVTFNPTTNTISGIATKVGTYPIVVTSTDAEGNSIETKFSIKVVDTTAPTVKGISDQTKEVNIAIDDIEIRATDNSGQAVTNKVSGLPQGVTFDPSTNTISGVATKVGTYPIVVTSTDADGNSVEMKFNIKVVDTTAPTVKEISDQTKEVNTAIDDIEISATDNSGQPVTNTVSGLPEGVTFDPRTSTISGVATKVGTYPIVVTSIDGDGNRTDTKFNIKVVDTTAPTVKGISDQTKEVNTAIDDIEISVTDNSGQAVTNKVSGLPQGVTFDSRTNTISGVATKVGTYPIVVTSTDAEGNSIETKFSIKVVDTTAPTVKGISDQTKEVNTEIDNIKIDARDNSGQAVTNTVNGLPEGVTFDSRTNTISGVVTKVGTYPIIVTSTDADGNSVETKFIIKVVDTTAPTVKEISNQTKEVNTAIDNIEIRATDNSGQPVTTKVSGLPEGVTFDSRTNIISGVATKVGTYPIVVTSTDADGNSVETKFIINVIDEDKLEIQPIPNQIVKINTHIKDVKIIITGGLGSTIISVSGLPKGLEFKSETLTISGIPKEPGRYDIIVTVIDSNSNQADVHFVIEVINDDNNKKPGKNSHIDDPEKPVIDNSHKNGIAIHGKTNSSKHVIIDLPSELTKTVNINNPGNYTIWVSGAHKMHKESYRIVERDKDNDIYVLPDTGNNSKSSTGIVATVLAMIGGILLLFKRRKNDEEK

SEQ ID NO: 43071 - protein, 190 aa, Staphylococcus lugdunensis; identical to SEQ ID NO: 43059
  strain N920143

SEQ ID NO: 43072 - protein, 2079 aa, Staphylococcus lugdunensis
  strain N920143
MKSKSNKNLGLSPIKQNKYSIRKFKLGAASVTVASLLIFGTAGVAKAAEVHGADKAQQAEHVANVAKSDTAKATEATPAASTQQNEVKTSEAPNTAKAVTDKEAITPTAAPKEDKVVSDKATTQDKKETRGYKANNTEPQKGTNAIANTGKHDPRNGQAIPGYGTSSFRDGGNTVSIDGGKITASGHVNVDDRVNTTTGISYDYTLNFKEGAFHEGDTFKIGIKELGEDTRLPKELKADDGTTFAIRDSYKSLYNNPNTNQIPFFSQRNPGTIDEKRSWHLQSRGTFLEGVYKFTKEVEKLKNLHFSFSNKDGLRFPEVTKDKRVTGAILVNDQVIASKDYTVVGQAISPAPVNLNKAVIDTSGDINIDKDGTVKSKWENLRLNTNGKTFTTNTTFTVTLPDTGMNSFEKVGDFNETGVMIVEVASNASNSVANENDVVLKAPKEDPSRIAKVRVESVQPNKLVFKLVSGQLDPNKVYVFLLKNMGVERKVNSTTLNYLSPDKSSISEQGATFEVTKDGQRLTDTYTTTAGVNWNVVGDRTKLNTGASLAFYDVTSRYIDGSGNLLISADPAVEHGLASVDEFNTHNPQPNFNEAQVGNPDNSHATITTTNGSNKKVTDITPPYLIKKDGKYYVFNQYLTKSNYYQNTRTSGTIEHSPVNVVAQYANAKFGTVSVGYEIKDSNEKLKADEVIRDGSAQLTNIVGNQYTVPSDKVPNTIEKDGILYVLSKVPADAPSNATGQIAETPTRVVYKYTNAYVSVTPENPGHPGQPIDPNNPSIVWPRYTDLASLTKSVTRTIKYVDAENTSKVLHAPVIQTVKFTRTPIVNVVNGRIVGYDEDGNGTIDTTSAENAWVPENSGATTWPEQTSPKANELTEQGYHETTTPSVAAVSVNASTISTEVLVKYQRQDKEKYEPTPGQINHDYGTPTTADEVKNSVKVPGYPTSVGIPTITVDNPNQIPNGQTPGTVVIPVTVTYPDGSKDKTTVTVVTGNPLKDAYEPSTKPINKPFGTPTTADEVKKAVTVPDYPSSKGTPEVTIDDQSKIPNGQTPGTYTVPVTVTYPDGSKDHANVTVNVGNPENSTYEPHVTPINKPFGTPTTADEVKKAVTVPDYPSSKGTPEVTIDDQSKIPNGQTPGTHNVPVTVTYPDGSKDHVNVPVNVGDPDSSRHEPKVTPITKDFGTPTTADEVKKAVTVPDYPSSKGTPVVTVDNPNTLPDGQTPGTHNVPVTVTYPDGTKDHVDVPVTVKEQPDKDKYEPKVTPVTKDFGTPTTADEVKKAVTVPDYPSSKGTPVVTVDNPSTLPNGQTPGTFTVPATVTYPDGTKDHVDVPVTVKEQPDKDKYEPTTKPITKSFGTPTTADEVQKAVTVPGFPSSKGTPVVTVDNPSTLPNGQTPGTYTVPVTVTYPDGTKDHTNVTVNVGDPDSGKYEPKVTPITKDFGTPTTTDDVTKAVTVPNYPSDKPAPKVSVDDPSTLPNGKTPGEYTVPATVTYPDGTKDHVNVPVKVGNPDSSKYEPKVTPITKDPDGNTTGTFTVPVTVTYPDGTKDHTNVTVNVGNPDSGNYPPKVTPITKDFGTPTTADDVTKAVTVPDYPSSKGTPTVTVDNPSTLPDGHTPGAHSVPVTVTYPDGSKTHVDVPVTVKEQPDKDKYEPSTKAITKPFGTPTTADEVKKAVTVPNYPSDKPAPKVSVDDPSTLPNGKTPGEYTVPVTVTYPDGSKDHVNVTVKVGDPDSGKYEPKVTPITKDFGTPTTADDVTKAVTVPNYPSDKPAPKVSVDDPSTLPNGKTPGEYTVPVTVTYPDGSKDHVNVTVKVGDPDSGKYEPKVTPITKDFGTPTTTDDVTKAVTVPNYPSDKPAPKVSVDDPSTLPNGKTPGTYTIPVTVTYPDGSKDHVNVTVKVGDPDSGKYEPKVTPITKDFGTPTTADDVIKAVTVPNYPSDKPAPKVTVDNPSTLPNGKTPGTVYVPVTVTYPDGSKDHVTVSVTTRPNKPSESVQPVQPNEPVQPAKDATPLVDGNHVTVDTQNHAKTATNQSTLDNKHQAPAKASEQKSLPDTGQKETTNTTLFAGLFAALATAMFVSRKRRKDNK

SEQ ID NO: 43073 - protein, 233 aa, Staphylococcus lugdunensis; identical to SEQ ID NO: 43060
  strain N920143

SEQ ID NO: 43074 - protein, 277 aa, Staphylococcus lugdunensis; identical to SEQ ID NO: 43062
  strain N920143

SEQ ID NO: 43075 - protein, 1859 aa, Staphylococcus lugdunensis
  strain N920143
MKRKKSKQKDYFSNVQNKYSIRKFSVGITSILIGASVIFGANSEAHTAEIKSDDNTQKVVNKEYSDGISQEQQDKSLNLAQDKEKSNNVNKNKVTDVGTSDVLKDTKTTHENVQQQDNVASKEETTKKTPSAIDKNNTSAQSEVVTSSDATKTSTALNQVDRNQLSSQSTSERPKKRVKRDVGTDDKQLVGEFVFSGTNSNERRYNLTSDIVSNRRVTSTSFSYSASGHGTIDNGKLVYEAPKKFIISEPTFSKSEFVTNKTNLSDNETWRYQFDLRPLSGTSAGQINISQVIGGMIWTGPGEGDVVTSTMKMYQGDTLVDTKQVNATFDHIKGGLYIDRGQEKPTSIWRITRKSAAAQSPTIGVIKEDGTISEKTDNYRYQVPLPRDNWFLENRDDAVSPHYYSRYTDFKYNILNIPSWLELDPDAKGNRFWTQDESGIHLHLNEGDILPYNGYTPVLKLKKSALTPELLAKFKTDGFIKVNLDWQTIGRLPNGQDYIQNVPDPEGIKFKMINEAGTATSNVYFMNFRLQEPSHLFSKADHKNEVFRVQKYIYDRDQSNKYAPTYMHSIQLPSGQEGDYFTTFKLSLPRINYNNGSSDKNADKGIVLKAPFILYGVNADGSTTKLNEWTSINNTNNTYGLGDKKYNHLILQTPIIRDTVSPDSEAEKDIYGWEADITYAVDDQRWETAAKDDDVTQMQNGIIINQVAENTLQAASSVPTRALTGNELQPAYSYIHTKDAFKHTLTDVDVRNTNSGLGNVLNYNEKANVIVKADTKDYMKYLSTDPLDNSSDISVDKLDHINHVYLSLSAPDDTAIGNVRVWTNNELIRTSTVWNPSLYETTPSNVLKNRPVLNPIKVIKNYKNSGRTLYIYEAPEGYKWNQSVKNSITERSSITQNTPEITFDIYNRGTLPTGTYSIRYATIWDENSEIVRPTEEQSLSHNNLELSDVITEDLSGNKKFVSVIDVPFKIALAKEYASTLTIGKDASNSFDKSQVDVNLGESVNLQTNTANFTNSEGIIKEIIVTIPKDNIKTNLTALIPDTEKYHVVYTTDTDVRNGVYNSNPTDLTKVTAVKYVFDEPLVLTNGQSFQTNMRVTVPEDAPILTKAHSQIFTKGLDNTWLSGNKVELETEDNRGDLVVKYTNESGNTIQNSLTSKGKKNTEYNVSVPQMIDRLNRHYKFVRVDNQLDPTTGHYAKGQTKIVNLIYVEVFEGSVIADYKTTDGEVLSPLVTVVNSQIEGTEYTATPATIPDRVTFETTDDGKVKKTISYHLISTPENQSGTVVGKQTIEVHYVYEPITTYEQIPNDAPQETPVALEVTRYVDSDGNEVQETEEGTHQPPSIIGDKWQYTGQTTTADGITTHVYERIQSEIPNEAPQETPVQLEVTRYVDTDGNEVQETEEGTHQPPGIIGDKWQYTGKVTEKDGITTYVYERIQSAIPNDAPQETPVQLEITRYVDGKDNEVQETTEGKHEPPGIIGDRWQYTGQTTTADGITTYVYERIQSEIPNETPQETPVQLEVTRYVDITGNEVQETEEGTHQPRYIIGDKWRYSGVTVTENGITKHVYERIQSKVPNDAPQETPVQLEVTRYVDPEGNEVQETTEGKHQPPGIIGDRWQYTGKVTEKDGIITYVYERIQSEIPNNPPQEIPVQLEVTRYVDPEGNEVQETTEGKHQPPSIIGDRWQYTGKVTEKDSITTYVYERIQSKVPNDAPRVDIDELKITIYVDTNGREIVPSRKGQLPPEQFIGQDWQYTGHKIEKDGITTYIYKKVENAVPAKQLKKTKHNTQSESQFKHTPQVKQQLVKYHNVKEQRSIEKSEHTDMHVSELPETGETANKNGLIGGLLIAIGAFFVTKRKKENTK

SEQ ID NO: 43076 - protein, 881 aa, Staphylococcus lugdunensis
  strain N920143
MKLTKKEKFSIRKHKFGVSSILVGSIIGLTMLMTKEAEAEEVERNLSKQQIQHNNDATGDTQDDNNYNNEISNQEATTQNKQITQSDNVNSEAQAINEISDSHRTVNKATEALDNNSTLNTSTDVSPATKQDTTTSNQTTQENNDATTQTKTNYKQDGNNNVLSQVATNDNQSSNQPRNSHLNTSTVTYNNNHQVRRLAKVEATNTDNNVTQTSDISNKLSNVTATIEAADTIYPHKAEYVNLNYRFQAPDDVQAGDSIKITIPQALNLNGVTATAKAPNIMAGDQILATGTIDEEGNLIYTFTDYVTNKNNITGQISIPGYIDPKNVTHTGKVNLETSIGQTTAKKTVTVDYEKYGEFRNLSIKGTIDQIDKVNNTYRQTVYVNPSSDTVVDPYLRGGSIPGTNSNVIIDEQNTSIKVYKVKEKAHLTDSYYVDPSNYEDVTSDVKITFPEKGIYQINFNTEDDQINSPYVVVINGHVDPNSNGNLYLRSTLYGYDSNFTRVSMAWDNEVEYHAGSGNGDGIDKPVIPDQPGDSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSNSGSDSNVDSDSDSENDNVSVEVDNNSNQRGISIMKAQHQHYDSNNTTQKNTDKSLPKTGEQSEQTGFISSILLFLGGLLFLNRRRSKKEDK

SEQ ID NO: 43077 - protein, 235 aa, Staphylococcus lugdunensis; identical to SEQ ID NO: 43063
  strain N920143

SEQ ID NO: 43078 - protein, 1689 aa, Staphylococcus lugdunensis ACS-027-V-Sch2
MKSKSNKNLGLSPIKQNKYSIRKFKLGAASVTVASLLIFGTAGVAKAAEVHGADKAQQAEHVANVAKSDTAKATEATPAASTQQNEVKTSEAPNTAKAVTDKEAITPTAAPKEDKVVSDKATTQDKKETRGYKANNTEPQKGTNAIANTGKHDPRNGQAIPGYGTSSFRDGGNTVSIDGGKITASGHVNVDDRVNTTTGISYDYTLNFKEGAFHEGDTFKIGIKELGEDTRLPKELKADDGTTFAIRDSYKSLYNNPNTNQIPFFSQRNPGTIDEKRSWHLQSRGTFLEGVYKFTKEVEKLKNLHFSFSNKDGLRFPEVTKDKRVTGAILVNDQVIASKDYTVVGQAISPAPVNLNKAVIDTSGDINIDKDGTVKSKWENLRLNTNGKTFTTNTTFTVTLPDTGMNSFEKVGDFNETGVMIVEVASNASNSVANENDVVLKAPKEDPSRIAKVRVESVQPNKLVFKLVSGQLDPNKVYVFLLKNMGVERKVNSTTLNYLSPDKSSISEQGATFEVTKDGQRLTDTYTTTAGVNWNVVGDRTKLNTGASLAFYDVTSRYIDGSGNLLISADPAVEHGLASVDEFNTHNPQPNFNEAQVGNPDNSHATITTTNGSNKKVTDITPPYLIKKDGKYYVFNQYLTKSNYYQNTRTSGTIEHSPVNVVAQYANAKFGTVSVGYEIKDSNEKLKADEVIRDGSAQLTNIVGNQYTVPSDKVPNTIEKDGILYVLSKVPADAPSNATGQIAETPTRVVYKYTNAYVSVTPENPGHPGQPIDPNNPSIVWPRYTDLASLTKSVTRTIKYVDAENTSKVLHAPVIQTVKFTRTPIVNVVNGRIVGYDEDGNGTIDTTSAENAWVPENSGATTWPEQTSPKANELTEQGYHETTTPSVAAVSVNASTISTEVLVKYQRQDKEKYEPTPGQINHDYGTPTTADEVKNSVKVPGYPTSVGIPTITVDNPNQIPNGQTPGTVVIPVTVTYPDGSKDKTTVTVVTGNPLKDAYEPSTKPINKPFGTPTTADEVKKAVTVPDYPSSKGTPEVTIDDQSKIPNGQTPGTYTVPVTVTYPDGSKDHANVTVNVGNPENSTYEPHVTPINKPFGTPTTADEVKKAVTVPDYPSSKGTPEVTIDDQSKIPNGQTPGTHNVPVTVTYPDGSKDHVNVPVNVGDPDSSRHEPKVTPITKDFGTPTTADEVKKAVTVPDYPSSKGTPVVTVDNPNTLPDGQTPGTHNVPVTVTYPDGTKDHVDVPVTVKEQPDKDKYEPKVTPVTKDFGTPTTADEVKKAVTVPDYPSSKGTPVVTVDNPSTLPNGQTPGTFTVPATVTYPDGTKDHVDVPVTVKEQPDKDKYEPTTKPITKSFGTPTTADEVQKAVTVPGFPSSKGTPVVTVDNPSTLPNGQTPGTYTVPVTVTYPDGTKDHTNVTVNVGDPDSGKYEPKVTPITKDFGTPTTTDDVTKAVTVPNYPSDKPAPKVSVDDPSTLPNGKTPGEYTVPATVTYPDGTKDHVNVPVKVGNPDSSKYEPKVTPITKDFGTPTTADEVQKAVTVPDYPSSKGTPVVTVDNPSTLPNGQTPGTHNVPVTVTYPDGSKDHVTVSVTTRPNKPSESVQPVQPNEPVQPAKDATPLVDGNHVTVDTQNHAKTATNQSTLDNKHQAPAKASEQKSLPDTGQKETTNTTLFAGLFAALATAMFVSRKRRKDNK

SEQ ID NO: 43079 - protein, 1926 aa, Staphylococcus lugdunensis ACS-027-V-Sch2
MKRKKSKQKDYFSNVQNKYSIRKFSVGITSILIGASVIFGANSEAHTAEIKSDDNTQKVVNKEYSDGISQEQQDKSLNLAQDKEKSNNVNKNKVTDVGTSDVLKDTKTTHENVQQQDNVASKEETTKKTPSAIDKNNTSAQSEVVTSSDATKTSTALNQVDRNQLSSQSTSERPKKRVKRDVGTDDKQLVGEFVFSGTNSNERRYNLTSDIVSNRRVTSTSFSYSASGHGTIDNGKLVYEAPKKFIISEPTFSKSEFVTNKTNLSDNETWRYQFDLRPLSGTSAGQINISQVIGGMIWTGPGEGDVVTSTMKMYQGDTLVDTKQVNATFDHIKGGLYIDRGQEKPTSIWRITRKSAAAQSPTIGVIKEDGTISEKTDNYRYQVPLPRDNWFLENRDDAVSPHYYSRYTDFKYNILNIPSWLELDPDAKGNRFWTQDESGIHLHLNEGDILPYNGYTPVLKLKKSALTPELLAKFKTDGFIKVNLDWQTIGRLPNGQDYIQNVPDPEGIKFKMINEAGTATSNVYFMNFRLQEPSHLFSKADHKNEVFRVQKYIYDRDQSNKYAPTYMHSIQLPSGQEGDYFTTFKLSLPRINYNNGSSDKNADKGIVLKAPFILYGVNADGSTTKLNEWTSINNTNNTYGLGDKKYNHLILQTPIIRDTVSPDSEAEKDIYGWEADITYAVDDQRWETAAKDDDVTQMQNGIIINQVAENTLQAASSVPTRALTGNELQPAYSYIHTKDAFKHTLTDVDVRNTNSGLGNVLNYNEKANVIVKADTKDYMKYLSTDPLDNSSDISVDKLDHINHVYLSLSAPDDTAIGNVRVWTNNELIRTSTVWNPSLYETTPSNVLKNRPVLNPIKVIKNYKNSGRTLYIYEAPEGYKWNQSVKNSITERSSITQNTPEITFDIYNRGTLPTGTYSIRYATIWDENSEIVRPTEEQSLSHNNLELSDVITEDLSGNKKFVSVIDVPFKIALAKEYASTLTIGKDASNSFDKSQVDVNLGESVNLQTNTANFTNSEGIIKEIIVTIPKDNIKTNLTALIPDTEKYHVVYTTDTDVRNGVYNSNPTDLTKVTAVKYVFDEPLVLTNGQSFQTNMRVTVPEDAPILTKAHSQIFTKGLDNTWLSGNKVELETEDNRGDLVVKYTNESGNTIQNSLTSKGKKNTEYNVSVPQMIDRLNRHYKFVRVDNQLDPTTGHYAKGQTKIVNLIYVEVFEGSVIADYKTTDGEVLSPLVTVVNSQIEGTEYTATPATIPDRVTFETTDDGKVKKTISYHLISTPENQSGTVVGKQTIEVHYVYEPITTYEQIPNDAPQETPVALEVTRYVDSDGNEVQETEEGTHQPPGIIGDKWQYTGQTTTADGITTYVYERIQSEIPNEAPKETPVQLEVTRYVDSEGNEVQETEEGTHQPPSIIGDKWQYTGQTTTADGITTHVYERIQSEIPNEAPQETPVQLEVTRYVDTDGNEVQETEEGTHQPPGIIGDKWQYTGKVTEKDGITTYVYERIQSAIPNDAPQETPVQLEITRYVDGKDNEVQETTEGKHEPPGIIGDRWQYTGQTTTADGITTHVYERIQSEIPNETPQETPVQLEVTRYVDITGNEVQETEEGTHQPRYIIGDKWRYSGVTVTENGITKHVYERIQSKVPNDAPQETPVQLEVTRYVDPEGNEVQETTEGKHQPPGIIGDRWQYTGKVTEKDGIITYVYERIQSEIPNNPPQEIPVQLEVTRYVDPEGNEVQETTEGKHQPPSIIGDRWQYTGKVTEKDSITTYVYERIQSKVPNDAPRVDIDELKITIYVDTNGREIVPSRKGQLPPEQFIGQDWQYTGHKIEKDGITTYIYKKVENAVPAKQLKKTKHNTQSESQFKHTPQVKQQLVKYHNVKEQRSIEKSEHTDMHVSELPETGETANKNGLIGGLLIAIGAFFVTKRKKENTK

SEQ ID NO: 43080 - protein, 437 aa, Staphylococcus lugdunensis ACS-027-V-Sch2; identical to SEQ ID NO: 43050

SEQ ID NO: 43081 - protein, 1136 aa, Staphylococcus lugdunensis ACS-027-V-Sch2; identical to SEQ ID NO: 43058

SEQ ID NO: 43082 - protein, 233 aa, Staphylococcus lugdunensis ACS-027-V-Sch2; identical to SEQ ID NO: 43060

SEQ ID NO: 43083 - protein, 674 aa, Staphylococcus lugdunensis ACS-027-V-Sch2
MKLTKKEKFSIRKHKFGVSSILVGSIIGLTMLMTKEAEAEEVERNLSKQQIQHNNDATGDTQDDNNYNNEISNQEATTQNKQITQSDNVNSEAQAINEISDSHRTVNKATEALDNNSTLNTSTDVSPATKQDTTTSNQTTQENNDATTQTKTNYKQDGNNNVLSQVATNDNQSSNQPRNSHLNTSTVTYNNNHQVRRLAKVEATNTDNNVTQTSDISNKLSNVTATIEAADTIYPHKAEYVNLNYRFQAPDDVQAGDSIKITIPQALNLNGVTATAKAPNIMAGDQILATGTIDEEGNLIYTFTDYVTNKNNITGQISIPGYIDPKNVTHTGKVNLETSIGQTTAKKTVTVDYEKYGEFRNLSIKGTIDQIDKVNNTYRQTVYVNPSSDTVVDPYLRGGSIPGTNSNVIIDEQNTSIKVYKVKEKAHLTDSYYVDPSNYEDVTSDVKITFPEKGIYQINFNTEDDQINSPYVVVINGHVDPNSNGNLYLRSTLYGYDSNFTRVSMAWDNEVEYHAGSGNGDGIDKPVIPDQPGDSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSD

SEQ ID NO: 43084 - protein, 235 aa, Staphylococcus lugdunensis ACS-027-V-Sch2; identical to SEQ ID NO: 43063

SEQ ID NO: 43085 - protein, 277 aa, Staphylococcus lugdunensis ACS-027-V-Sch2; identical to SEQ ID NO: 43062

SEQ ID NO: 43086 - protein, 690 aa, Staphylococcus lugdunensis ACS-027-V-Sch2; identical to SEQ ID NO: 43052

SEQ ID NO: 43087 - protein, 291 aa, Staphylococcus lugdunensis ACS-027-V-Sch2; identical to SEQ ID NO: 43048

SEQ ID NO: 43088 - protein, 2814 aa, Staphylococcus lugdunensis ACS-027-V-Sch2
MKSNKKPAQFLNRHNNYSIRKFTIGTASILVGTTLIFGLSNEAHAQSNSSAKVSDKVATEQSASTSQEADSSQQTAASNAQNVQTAPEQDKATPTTEVNSNNNQTDSKHVAPQKEQNQTATQTESKKETAQTQAKTEEKAASDSKKASEDSDDKATSKETDENKTDDSVDTNSNITTPVYDTTRARAATSVPLASSLDSDASAAENAEPPAEFIDKYNKSTNRSQLVHDLLAESYSETDVRAIVNRLNIDFNKTDAKKAFQAIMYAGIQYAKEQTSLYTTYATIPGDGVNVNNTEIGSVAELKRSIYIDPNKGLTVNGQGYTSQGQSPANYTVHVQPNKRTNKMDFTVTWKVNPSASASGHDADLGGFNFGSGYNVPERINGRFNIYGGNTISNNLDMIKSPHPSYPAGYGLSSRPTITRYFVQRGGRVEYHFSVPVRDWNGDLSFNGKVLMFDNNVTLVGQGVMNPNSNDNYFYDEMNIQGDNNPDRHIITTDDTSEVENIPFQIEYVVSKDLPVGQQEVQREGQVGKRGTLYSIVKFNNQTIGRFVKETYNIPPVNKIIKIGIGAVNDSNISGPLPPILEPQLSGTNIVSGETSPNAAVTITVGGRNYQTTSDNSGRFNFQLPNYTLQEGDHISAVATVEGKTSKPGKIIIPRDGRTPNLTTSVQRGQDQNKPGSWVTITNATTGQQVSRFFVPDGLPGNDGRSITITNEYLDPSTGERVVQFSDGRTIRLPKGPKGDKGDTGAQGPAGRSITITSTTVDADGNTNVRFSDNTTLKIPKGPKGDKGDQGPAGKSITVKHISKDSQGNTTVQFSDNSSIIIPAGTPGRNGTSVGIRTITPQANGDTVVTFTDGKTMTIPKGAKGDRGEAGPKGADGHSITITSNTVEPNGDRKIVFSDHTTVVIPKGDKGDKGDNGTSIGITQIDTDAAGNKVVHFTDGKTMTVPKGQDGTSIGIKSITPQANGDKLVTFTDNRTMVIPKGDKGDKGDKGDKGADGASPTVTATRTQHDGKDGVEITITPANGGTPIKTFVADGERGERGLQGINGVDGKSIRVSSSRDNQKHETTLTFYYDQDGDQAFDASKDIVVDTAVIKDGRTPTVDIKKILRGVSTFRTATATANPDKGHEVKFYYDNNNNGIFDEGDEEISSGFIADGKNGQNGRNGRQGTELISGITPPTDSDGLNGDTYIDTNTGDTYKKENGKWVPSGNIKGPKGDKGENGQNGRDGKDVLNGKVDPQSSQGKDGDKYINTVTGDVFVKSGDNWTNEGNIKGPKGDKGDNGLNGRDGKDVLNGKVNPQPSQGKDGDKYINTVTGDVFVKSGDNWTNEGNIKGPKGDRGERGETGAKGDKGDNGQNGRDGKDILNGKVNPQSSQGKDGDKYINTVTGDVFVKSGGNWTNEGNIKGPKGDRGERGETGPKGDKGENGTSIGITTIDTDSAGNKVVRFTDGKTMTIPKGQDGTSIGIRTITPQTNGDTVVTFTDGKTMTIPKGAKGDKGDNGRDGTSIGITNIQTDAAGNNIVHFTDGKTMTVPKGQNGTSIGIRTITPQANGDIVVTFTDGKTMTIPKGAKGDKGDVGARGADGRSITITSNTEQPNGDRKLVFSDNTTVIIPKGAKGDKGDKGDNGTSIGITTIDTDTVGNKVVHFTDGKTMTVPKGQDGQSVGVKTITTATNGDTVVTFTDGKTMTIPKGAKGDKGDVGARGADGRSITITSNTEEPNGDRKLVFSDNTTVIIPKGAKGDKGDVGAKGADGHSITITSNTVEPNGNRKLVFSDNTTVVIPKGDKGDAGVKGADGHSITITGNTQEANGDRKLTFSDNTTVVIPKGDKGDKGDNGQNGTSVSITTIDTDSTGNKVVHFSDGKTLTVPKGQDGTSIGIKSITTSANGDKVVTFTDNQVLTIPKGEKGDRGDNGHDGQNGRDGASITITRTETDAAGNTVIHFSDGKNVTVPKGQNGTSVTIQNIAKQPNGDTLVTFSDGKSITVPKGDKGDAGVKGADGHSITITSNTEEPNGDRKLVFSDNTTVVIPKGAKGDKGENGTSIGISRTEVDGSGNTVVHFTDGKVITIPKGQNGTSVGIATITTSSTGDKVVTFTDGKTLTIPKGDKGDRGDNGHDGTSITITRTETDGNGNTVIHFSDGKNVTVPKGQNGTSVTIQNVTKQPNGDTVVTFSDGKTITIPKGDKGDAGVKGADGHSITITSNTEEPNGDRKLVFSDNTTVVIPKGAKGDKGDNGQNGASITITRTETDAAGNTVIHFSDGKNVTVPKGQDGTSIGIKSITTSTTGEKVVTFTDGQVLTIPKGEKGDRGENGHDGQNGRDGVSITITSTTTDGAGNTVIHFSDGKNVTVPKGQNGTSVTIQNVTKQPNGETVVTFSDGKSITIPKGEKGDAGVKGADGHSITITSNTEEPNGDRKLVFSDNTTVVIPKGTKGDKGENGTSISITTIDTDNDGNKVVHFSDGKTLTVPKGQDGTSIGIKTITTSTTGDKVVTFTDGKSITIPKGDRGENGQKGQDGQSITITSTTTDGAGNTVIHFSDGRNVTVPKGQDGQNGTSITVTNTELDKDGNAVVHFSDGKTVTIPKGAKGDRGENGHDGQNGTSISITSTTTDSAGNTVIHFSDGKTVTIPKGQDGHAIDIQSVTKNPQGDTVITFTNGKTVTIPKGEKGDRGENGHDGQNGTSISITSTTTDSAGNTVIHFSDGKTVTIPKGQDGTSVGIQNITKQPTGETVVTFTDGKSITIPKGDKGQDGKSITIISNTIEPNGDRKVVFSDNTSIIVPKGDKGDHGENGHDGTSVTVTNTTTDGDGNTVIHFSDGKTV

SEQ ID NO: 43089 - protein, 198 aa, Staphylococcus lugdunensis ACS-027-V-Sch2; identical to SEQ ID NO: 43054

SEQ ID NO: 43090 - protein, 646 aa, Staphylococcus lugdunensis ACS-027-V-Sch2; identical to SEQ ID NO: 43053

SEQ ID NO: 43091 - protein, 727 aa, Staphylococcus lugdunensis ACS-027-V-Sch2
MKIDAKDNSGQAVTNTVRGLPNGVTFDPRTNTISGVVTKVGTYPIVVTSTDADGNSIETKFIIKVVDTTAPTVKGISNQTKEVNTEIDEIVIDATDNSGQTMTNTVSGLPEGITFDPSTNTISGVATKVGTYPIVITSTDADGNSVETKFNIKVVDTTAPTVKGISNQTKEVNTAIDDIEISAKDNSGQPVTTKVSGLPNGVTFDSRTNTISGVATKVGTYPIVVTSTDADGNRTETKFIIKVVDTTAPTVKEISDQTKEVNTAIDDIEISVTDNSGQAVTNKVSGLPQGVTFDSRTNTISGVATKVGTYPIVVTSTDAEGNSIETKFSIKVVDTTAPTVKGISDQTKEVNTEIDNIKIDARDNSGQAVTNTVNGLPEGVTFDSRTNTISGVVTKVGTYPIIVTSTDADGNSVETKFIIKVVDTTAPTVKEISNQTKEVNTAIDNIEIRATDNSGQPVTTKVSGLPEGVTFDSRTNIISGVATKVGTYPIVVTSTDADGNSVETKFIINVIDEDKLEIQPIPNQIVKINTHIKDVKIIITGGLGSTIISVSGLPKGLEFKSETLTISGIPKEPGRYDIIVTVIDSNSNQADVHFVIEVINDDNNKKPGKNSHIDDPEKPVIDNSHKNGIAIHGKTNSSKHVIIDLPSELTKTVNINNPGNYTIWVSGAHKMHKESYRIVERDKDNDIYVLPDTGNNSKSSTGIVATVLAMIGGILLLFKRRKNDEEK

SEQ ID NO: 43092 - protein, 1457 aa, Staphylococcus lugdunensis ACS-027-V-Sch2
MKKGVSVINPEEKRQQLHSIRKFKVGTASILIGVTLIFGVPKVAYAEEMQAIQSNKQANDSSEETKSNNKQQNNLHGQTTEEQQNISTITETSVDNSKALNTADSSTSEQQDNDITTDATTKSIQSNENVIHQNTTNDAKNEKSNANIIKSKNETTTNENINPQNSVKENLTAKFKNTTETTNQQAAQIQSTTQKSTSAQTTLKQSRKLVQEKSQQDTTVTSKNNSNNSDQNTTLSGVTPFTNSNGDKTNEEKVVTTQPITVKQRRALMVKSNYAADTSISDPKVIDYPTPKNSKYSYMLHELGYNATTVSDESSLRFAGITQNKNSNGSTITLNLTKWNSATTNLNNGKINLSFSQSKFFSQIESISFDGTNMITDNNGQNWYTPASNANLGLIGSVTNSPIIITLKNNQSLTSLGYSNTNPVYFTHTWTLNDGSIAPESIQNALITPTLNPKVPQSTQSSGFTTGRLINKIDISRTDNTIKSIHSFKPDENFLQTDYNWVLYVKEQIPKELMPYIDRGSINIYVSDIFGNPISSDRNVQGFVDDNGFIDSSKINEISIKDNNTTSHLNSARGSLDHNVFYGTLGQSRNYTISYKLKDGVTIEQLQRELSDRLTFSSWLETDYLDSRDNGSANNRLMGSYASSYVDLIDRVPPEKPVANNITTDDKAIIGTAEANTKINLAFSDGHILTGTVDSNGNFSVSIPSGFNLTGKETISITAIDKGLNVSQPTTITVTDTTPPSLEDINSQVVLINTAINNVKINATDNSGDPIKITISQLPNGVSYNSDTQEISGKPTQVGVYPITVTATDASGNVSTTSFAITARDITAPDVKPIENQTIEINTAISNILINATDDSGLPVNNTVSGLPDGVTFDSTTNTISGIPTTLGTYPIEVMSKDNENNVTKTKFTIFVQDTTSPVVNAIQSQTVEINTPINSIKIDAKDNSLGSVVNTVSGLPDGITFDSETNTISGTPTQTGTSKIVIISTDASGNQTVTNTTIVVRDTIKPVVNPISNQKKEVNTPIDDIKIVASDNSNQDVTIVVTGLPRGVIFDTTTNTISGSPKEVGKYEFKVTVEDNAKNSTETRFTIEAVDTTAPTVKGINDQTKEVNTAIDNIKIDASDNSGQAVTNTVNGLPEGVTFDPKTNTISGVATKVGIYPIVVTSTDNQGNKVDTTFTIKIVDTTAPTVKEISDQTKEVNTAIDEIVIDATDNSGQAVTNKVRGLPEGVTFNPTTNTISGTATKVGTYPIVVISTDADGNRTDTKFIIKVVDTTAPTVKGISDQTKEVNTAIDDIEISATDNSGQPVTNTVRGLPSGVTFDPTTNTISGIATKVGTYPIVVTSTDTEGNSVETKFSIKVVDTTAPTVKEISDQTKEVNTAIDNIEISATDNSGEVVTNRVSGLPEGVTFDSRTNTISGVATKVGTYPIVVISTDAEGNSVETKFIIKVVDTTAPTVKEI

SEQ ID NO: 43093 - protein, 329 aa, Staphylococcus lugdunensis ACS-027-V-Sch2; identical to SEQ ID NO: 43064

SEQ ID NO: 43094 - protein, 238 aa, Staphylococcus lugdunensis ACS-027-V-Sch2
DSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSNSGSDSNVDSDSDSENDNVSVEVDNNSNQRGISIMKAQHQHYDSNNTTQKNTDKSLPKTGEQSEQTGFISSILLFLGGLLFLNRRRSKKEDK

SEQ ID NO: 43095 - protein, 190 aa, Staphylococcus lugdunensis ACS-027-V-Sch2; identical to SEQ ID NO: 43059

SEQ ID NO: 43096 - protein, 291 aa, Staphylococcus lugdunensis M23590
MNKIQSWLSKYKIKNKPTMIALISFVLFLILLFLFLNHNDQKSDRITVVENSELRTGPNAAYPVIEKVDKGEGFTKINQTGKWIEVQNRQETKKGWIAGWHTSLNIKKDVSQSQEPLKGKTIVLDPGHGGSDQGASSRTNKKSLEKNYTLKSALELKTLLEKEGAHVKMTRSDDEYVKLEDRKASGDIFMSIHNDSLESSVANGATVYWYKDSQSKLAETLNASIQKKALLSNRGAKQENYQVLRQSKIPAVLLELGYISNPTDETMIRDQHHRHIVLEGVVDGLKQYFAS

SEQ ID NO: 43097 - protein, 857 aa, Staphylococcus lugdunensis M23590
MKLTKKEKFSIRKHKFGVSSILVGSIIGLTMLMTKEAEAEEVERNLSKQQMQQNNDATGDTQDDNNYNNEISNQEATTQNQQITQSDNVNSETQAINEISDSHRTVNKATEALDNNSTLNTSTDVSPATKQDTTTSNQTTQENNDATTQTKTNYKQDDNNNVLSQVATNDNQSSNQPRNSHLNTSTVTYNNNHQVRRLAKVEATNTDNNVTQTSDISNKLSNVTATIEAADTIYPHKAEYVNLNYRFQAPDDVQAGDSIKITIPQALNLNGVTATAKAPNIMAGDQVLATGTIDEEGNLIYTFTDYVTNKNNITGQISIPGYIDPKNVTHTGKVNLETSIGQTTAKKTVTVDYEKCGEFRNLSIKGTIDQIDKVNNTYRQTVYVNPSSDTVVDPYLRGGSIPGTNSNVIIDEQNTSIKVYKVKEKAHLTDSYYVDPSNYEDVTSDVKITFPEKGIYQINFNTEDDQINSPYVVVINGHVDPNSNGNLYLRSTLYGYDSNFTRVSMAWDNEVEYHAGSGNGDGIDKPVIPDQPGDSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDSDSDSDADSDSDADSDSDADSDSDADSDSDADSDSDADSDSDADSDSDADSDSDADSDSDADSDSDADSDSDADSDSDADSDSDADSDSNSGSDSNVDSDSDSENDNVSVEVDNNSNQRGISTMKAQHQHHDSNNTTQKNTDKSLPKTGEQSEQTGFISSILLFLGGLLFLNRRRSKKEDK

SEQ ID NO: 43098 - protein, 437 aa, Staphylococcus lugdunensis M23590; identical to SEQ ID NO: 43050

SEQ ID NO: 43099 - protein, 206 aa, Staphylococcus lugdunensis M23590
MTVTYPDGSKDHVNVTVKVGDPDSGKYEPKVTPITKDFGTPTTADDVTKAVTVPNYPSDKPAPKVTVDNPSTLPNGKTPGTVYVPVTVTYPDGSKDHVTVSVTTRPNKPSESVQPVQPSEPVQPAKDATPLVDGNHVTVDTQNHAKTATNQSTLDNKHQAPAKASEQKSLPDTGQKETTNTTLFAGLFAALATAMFVSRKRRKDNK

SEQ ID NO: 43100 - protein, 1818 aa, Staphylococcus lugdunensis M23590
MKSKSNKNLGLSPIKQNKYSIRKFKLGAASVTVASLLIFGTAGVAKAAEVHGADKAQQAEHVANVAKSDTAKATEVPPAASAQQNEVKTSEAPNTAKAVTDKEAITPTAAPKEDKVVSDKATTQDKKETRGYKANNTEPQKGTNAIANTGKHDPRNGQAIPGYGTSSFRDGGNTVSIDGGKITASGHVNVDDRVNTTTGISYDYTLNFKEGAFHEGDTFKIGIKELGEDTRLPKELKADDGTTFAIRDSYKSLYNNPNTNQIPFFSQRNPGTIDEKRSWHLQSRGTFLEGVYKFTKEVEKLKNLHFSFSNKDGLRFPEVTKDKRVTGAILVNDQVIASKDYTVVGQAISPAPVNLNKAVIDTSGDINIDKDGTVKSKWENLRLNTNGKTFTTNTTFTVTLPDTGMNSFEKVGDFNETGVMIVEVASNASNSVANENDVVLKAPKEDPSRIAKVRVESVQPNKLVFKLVSGQLDPNKVYVFLLKNMGVERKVNSTTLNYLSPDKSSISEQGATFEVTKDGQRLTDTYTTTAGVNWNVVGDRTKLNTGASLAFYDVTSRYIDGSGNLLISADPAVEHGLASVDEFNTHNPQPNFNEAQVGNPDNSHATITTTNGSNKKVTDITPPYLIKKDGKYYVFNQYLTKSNYYQNTRTSGTIEHSPVNVVAQYANAKFGTVSVGYEIKDSNEKLKADEVIRDGSAQLTNIVGNQYTVPSDKVPNTIEKDGILYVLSKVPADAPSNATGQIAETPTRVVYKYTNAYVSVTPENPGHPGQPIDPNNPSIVWPRYTDLASLTKSVTRTIKYVDAENTSKVLHAPVIQTVKFTRTPIVNVVNGRIVGYDEDGNGTIDTTSAENAWVPENSEATTWPEQTSPKANELTEQGYHETTTPSVAAVSVNASTISTEVLVKYQRQDKEKYEPTPGQINHDYGTPTTADEVKNSVKVPGYPTSVGTPTITVDNPNQIPNGQTPGTVVIPVTVTYPDGSKDKTTVTVVTGNPLKDAYEPSTKPINKPFGTPTTADEVKKAVTVPDYPSSKGTPEVTIDDQSKIPNGQTPGTYTVPVTVTYPDGSKDHANVTVNVGNPENSTYEPHVTPINKPFGTPTTADEVKKAVTVPDYPSSKGTPEVTIDDQSKIPNGQTPGTHNVPVTVTYPDGSKDHVNVPVNVGDPDSSRHEPKVTPITKDFGTPTTADDVTKAVIVPDYPSSKGTPTVTVDNPSTLPNGQTPGTYTVPATVTYPDGSKDHVNVPVTVKEQPDKDKYEPKVTPITKGFGTPTTADEVKTAVTVPDYPSSKGTPTVTVDNPSTLPNGQTPGTHNVPVTVTYPDGTKDHVNVPVTVGDPDSSRHEPKVTPITKDFGTPTTTDDVTKAVTVPDYPSSKGTPVVTVDNPSTLPNGQTPGTYTVPATVTYPDGSKDHVNLPVTVKEQPDKDKYEPKVTPITKDFGTPTTTDDVTKAVTVPDYPSSKGTPTVTVDNPSTLPNGQTPGTYTVPATVTYPDGSKDHVNLPVTVKEQPDKDKYEPKVTPVTKDFGTPTTADDVTKAVTVPDYPSSKGTPKVSVDNPSTLPNGQTPGTYTIPVTVTYPDGTKDHVDVPVTVKEQPDKDKYEPSTKAITKPFGTPTTADEVKKAVTVPNYPSNKPTPEVSVDDSSKIPDGNTTGTFTVPVTVTYPDGTKDHTNVTVNVGNPDSGNYPPKVTPITKDFGTPTTADDVTKAVTVPDYPSSKGTPTVTVDNPSTLPDGHTPGAHSVPVTVTYPDGSKTHVDVPVTVKEQPDKDKYEPSTKAITKPFGTPTTADEVKKAVTVPNYPSDKPAPKVSVDNPSTLPNGK

SEQ ID NO: 43101 - protein, 277 aa, Staphylococcus lugdunensis M23590
MKFYQQQRFGIRKFAIGIGSVALATVVFLGANQDAYASETSRTATEQNQSHAQHQANTQNQHTSGKHTSEVDITSPYGKTTDIIEKNNSNQNSSSHSKTEIILGSTDGEWLINDITIINSETHHTSQNNHSSHNIKTEKQSTSKKIQHTGSSVKTVSQQRTSQSRLTKQAVQHQSQKQNVEKHSKIVNPSTAAVNVEQPFNPSQHNELNHTHQTLINQTKKPTVTHATSSNMTVTAPITHKALPNTGKEETPEHSMALASILAVLGSALFMRRRKHI

SEQ ID NO: 43102 - protein, 196 aa, Staphylococcus lugdunensis M23590
MNGGFIMKQMVQIILSVFALFLVLTATSVCVTQADTMSQQDAITTAKQAMARSGGNPDLQNFNTVIDKGNYFKIKITLKTNDSVGTYKVYKNGQVEYKNGKFGVYNLLNPNQTYAASEIANTSTHMAQQEQQNNPVDCKKELNRYYVGNIKSTELPQQNASLPETGHTSNNIITLAFGILALMSGLALTFMRNSKH

SEQ ID NO: 43103 - protein, 2202 aa, Staphylococcus lugdunensis M23590
MTNRKRNSSQRMDFIPNKLNKYSIRKFTVGTASILVGATLFLGHHEAEAAEKQQSISQNHSDEQESSQADTTVTTEQTTNNNVSSQTNATSPSTQDKTTIDHTENPSSTNQQITENQSLHAKDLQTSNQNNVSHKDTANKSTEKEARQHQNHKSTIQQQESSEKLATAAQNASATNQAVSINTNETHVQYADKKLSQIGVNHQTKEQVKASLVTKKAFKPRSKRDLDNTIVAEALKADITNPDYGVRTPATPVTAAASTSPTTRALSSNYRVRALAAATPTGKDVSDKIKFSNIDIAVEGRTAHTNASGQRELWVTSGDILSLKADYTVDNSVKSGDTFTIGYGQYIRPGGFSLPSSDTELRDANGAIIAKGKYDSNTNKTTYTFTNYVDQYDNIQGSFKIAATAKRENAINDKGSYNMDVKIGNVSFNKNIIVDYGDNKNNPLNASTLYRDPKTNQQYRIIYINEPGKTYKNVKYHSTTMNGKLIDGTDAIKVYKVNDPSAMVNSFAPDLTSSKVTDVTSSKTITYDNNRSTVNVSLGNLDGKTRYIIAEKVEPTTDNGNLSSTFSITNDDKNNPTIWAASTTQGSAGDNSTGSGQQTGKYSLGDTVWNDKNRNGIQDIGEEGIPNVYVTLKDANGNEIDRVTTDENGNYKFKNLKNGEYTLEYSTPNGGYSLTKADQSNNDAVDSDAQLVNGKYVAKATIQDDDNMTVDAGFYKSVYNIGDFVWNDTNKNGIQDDGEKGLAGVTVLLKDEQGRTIATTVTDKNGKYGFYELESGNYTVQFITPDGYTLSPSKVGTDVTKDSNGDEVPIQLTENDYSNDLGLYKPDAPKLDDYEITVEDKSYENTVRVNTKLPKNTIQLAQQGKDGRDRVYYKQLGYHPDLTGKDASKLLQRDGYYFEEVRRDHIYQSQDAIFEYNLDNNTGVKNITYNPTTNTYTVTYQDGSTKELPGQQPKGLTINNSYINQNGDTIVEFSDGTTITIPKGKDGVDGKKGEDGKTPKIEQTPITDSSGKQIGVTITVKDGDGKVINTQKVLNGQDGAKGNPGEKGEKGDPGTKGDKGEKGDTGAAGRDGQNGQDGKSVIANTERGTKDGQEGAYIRIYEVNPDGSRGTMISETFIKDGVKGQDGKDGRSPSIQQTPIKDEKGKIIGTTITILSPDGQEVSHQDILNGKDGQNGTSVTTITERGRQNDQTGAYVRTYERNPDGSRGKLISETFISDGQNGKDGQNGMNGKSITAETRPGTDADGNTGAWIRVYELNPDGTKGQLISETFIKNGAKGEKGEDGKTPKIEQTPIRDSSGNQIGVTITVTDGDGNVVSKENILNGKDGAKGENGKTPSVEQQAIQDKDGKQIGVTIIIKDGDGKEISRQNILNGQDGKNGTPGKDGQTPTVETMPALDKDGKQIGVTIITRDGDGKEIGRQTVTNGQDGKSITAVTARGEQNNQTGSWIRVYEVNPDGTRGKLISETFVADGQKGADGKNGVDGKDGKTPTIEQQPIRDKDGKQIGVTIIIKDGDGKEISRQKILNGQDGQKGANGQDGKSVTAITERGTQDGHKGSYIRIYEMNLDGTRGKLISETFIADGEKGRDGVDGQDGKSVTAETTRGDKDGQTGAYVRIYQTNPDGTRGKLISETFIADGQKGKNGQDGKTPTIEQLPILDKNGKQVGVTVIVKDGNGKEISRQDIYNGRDGQDGKDGKTPSIEQQPILDKNGKQIGTTVIIKDGDGKEVSRQDIHNGQDGKTPTIEQVPSLDKEGNQNGIIVIIKDGDGKEISRQTILNGQDGRDGRDGKAPHVEQQPILNKDGKQIGITVIIKDGDGKEISRQNIYNGEKGKDGKDGKDGVDGKSITAITERGTKDGKSGSYIYIYEMNSDGSRGKLISQTFIEDGQDGKTPSIEQQPVKDEKGHQVGVVIIVKDGDGKEISRQVIANGKDGQDGKTPSIEQQPIKDENGKQIGITIIVKDGNGKEVSRQNIYNTSNITNIYVNVEGNIVFVFKDGTTCICKCEPNKPNEPGKPSEPGKPNEPNKPSEPGKPSEPGKPSEPNKPSEPGKPNEPSKPSEPNKPSEPSKPSEPNKPSEPGKPNEPSKPSEPNKPSEPSKPSEPNKPSEPSKPSEPSKPSEPNKPSEPSKPNKSVHTSTMKHVNYKTTSHLQQVHDTTQSNNDKKQQELPATGAVDDNGYQAPFFGSLFAISGTILFLARRRKHHHQ

SEQ ID NO: 43104 - protein, 1632 aa, Staphylococcus lugdunensis M23590
MKSNKKPAQFLNRHNNYSIRKFTIGTASILVGTTLIFGLSNEAHAQSNSSAKVSDKVATEQSASTSQEADSSQQTAASNAQNVQTAPEQDKATPTTEVNSNNNQTDSKHVAPQKEQNQTATQTESKKETAQTQAKTEEKAVSDNKKASEDSDDKATSKETDENKTDDSVDTNSNITTPVYDTTRARAATSVPLASSLDSDASAAENAEPPAEFIDKYNKSTNRSQLVHDLLAESYSETDVRAIVNRLNIDFNKTDAKKAFQAIMYAGIQYAKEQTSLYTTYATIPGDGVNVNNTEIGSVAELKRSIYIDPNKGLTVNGQGYTSQGQSPANYTVHVQPNKRTNKMDFTVTWKVNPSASASGHDADLGGFNFGSGYNVPERINGSFNIYGGNTISNNLDMIKSPHPSYPAGYGLSSRPTITRYFVQRGGRVEYHFSVPVRDWNGDLSFNGKVLMFDNNVTLVGQGVMNPNSNDNYFYDEMNIQGDNNPDRHIITTDDTSEVENIPFQIEYVVSKDLPVGQQEVQREGQVGKRGTLYSIVKFNNQTIGRFVKETYNIPPVNKIIKIGIGAVNDSNISGPLPPILEPQLSGTNIVSGETSPNAAVTITVGGRNYQTTSDSSGRFNFQLPNYILQEGDHISAVATVEGKTSKPGKIIIPRDGRTPNLTTSVQRGQDQNKPGSWVTITNATTGQQVSRFFVPDGLPGNDGRSITITNEYLDPSTGERVVQFSDGRTIRLPKGPKGDKGDTGAQGPAGRSITITSTTVDADGNTIVRFSDNTTLKIPKGPKGDTGDQGPAGKSITVKHISKDSQGNTTVQFSDNSSIIIPAGTPGRNGTSVGIRTITPQANGDTVVTFTDGKTMTVPKGQDGTSIGIKSITPQANGDKLVTFTDNRTMVIPKGDKGDKGDKGADGASPTVTATRTQHDGKDGVEITITPANGGTPIKTFVADGERGERGLQGINGVDGKSIRVSSSRDNQKHETTLTFYYDQDGDQAFDASKDIVVDTAVIKDGRTPTVDIKKILRGVSTFRTATATANPDKGHEVKFYYDNNNNGIFDEGDEEISSGFIADGKNGQNGRNGRQGTELISGITPPTDSDGLNGDTYIDTNTGDTYKKENGKWVPSGNIKGPKGDKGENGQNGRDGKDVLNGKVDPQSSQGKDGDKYINTVTGDVFVKSGDNWTNEGNIKGPKGDKGDNGLNGRDGKDVLNGKVNPQPSQGKDGDKYINTVTGDVFVKSGGNWTNEGNIKGPKGDRGERGETGAKGDKGDNGQNGRDGKDILNGKVNPQPSQGKDGDKYINTVTGDVFVKSGGNWTNEGNIKGPKGDRGERGETGPKGDKGENGTSIGITTIDTDSAGNKVVRFTDGKTMTIPKGQDGTSIGIRTITPQTNGDTVVTFTDGKTMTIPKGAKGDKGDNGRDGTSIGITNIQTDAAGNNIVHFTDGKTMTVPKGQNGTSIGIRTITPQANGDTVVTFTDGKTMTIPKGAKGDKGDVGARGADGRSITITSNTEQPNGDRKLVFSDNTTVIIPKGAKGDKGDNGTSIGITTIDTDTVGNKVVHFTDGKTMTVPKGQDGQSVGVKTITTATNGDTVVTFTDGKTMTIPKGAKGDKGDVGARGADGRSITITSNTEEANGDRKLV

SEQ ID NO: 43105 - protein, 233 aa, Staphylococcus lugdunensis M23590; identical to SEQ ID NO: 43060

SEQ ID NO: 43106 - protein, 198 aa, Staphylococcus lugdunensis M23590; identical to SEQ ID NO: 43054

SEQ ID NO: 43107 - protein, 646 aa, Staphylococcus lugdunensis M23590
MKKHQRTQTNKFGFIANHYSIRKFSVGTASIIVGSLLFLGNPAHAAEANTTQNEPATHQENKVETNIDPIIIDQPQNQAATTNQTPKTEQNHTQANKQLAKSNQAAAVTSDSKSQNDAQASPKQSSTSKQDAVKQQATQANTKAPAQPATQQTREAQPVVRSVKSATSETTEDFEFQVNKDKTKQKSTMNQYMNHPGKLVHANNKYYFEAELNHAKWWKSFEFYDENNNKLNTVVTKDDTSKNIKTIRVEVASGTQQLISKVHIIVPVINYDHEYTTQIAFAKPVPQPAKAQASKAQALDVQSTQKNAVKPETLAQAKNVARPSVMTLSAKKPASQQAKSAAVTQTAKYKVQKDKSTETSVMDGYMEHPGKFIKENGKTYFEVTLKNADWWKSFQFFTPQNKELTTTVVKHDKKADTKTIRVEVKPGMKQLISRVHIVVPAINYDNKYQTTLLFETPVPELTTAKPETPKTKPANKTNKAKTSTTKPTKANKENKANKTKKVDKAKNNAPKVVQPATTVNQHSKAAATHTTIKTSHVSTTVNHDATATQHHTPVVASTYKPAKDEVKAQATMAQPTTQQHVHLSQNKHEDKQHIAMTKPQPAQQSHMHSLPNTGQENATTSASIFGSLLALGGSILLFGRKRKEQR

SEQ ID NO: 43108 - protein, 714 aa, Staphylococcus lugdunensis M23590
MYNHFNSTDNDYQLRKNKLGVVKTMKTHHENNNARPNQHFSIRKFSIGAASITLGTCLFLNAEHQAQAAENAVEPAHSAAASESNTPAQSKPVAPTVETNAQPNADHTDKTVAATTTNDKSRAQANDKQTVTPATNVSNTTQPKAAPAPTALTTNAVNPKSSTAVSNPAKQAVDQSIKDAVKDKTYTNKPHDTSNSRPVSFEMKNKDGDLQFYHYASTISPANVYFNKDKNKTTVELGLKTASTWKKFEVYENNKKLPIELVTYNPETDDAYIRFDVSNGIKELVIKSSTQIYNDPETNYDYTKMVFEQPIYNDESKFKTREDFETEALLADYNKAKTLERKIYELNRVKDQLPEKLRAQYSQKLEQLKKDLDQEVASAKVEFEHAPVKKVQITNSKSLDISVLQSDDDDLSTMDGFVEKPFELVEVDGKKYIKLTTTIDSIWKDFQVEGQRVMTIDKDTVNDKRTVLFPYVEGKEIYNSIVKVDFPTIGYSGQYHVRIKNNAISKKADAEAPTTPNNKKDAKPDINQADTATSNNKKADKPIVKPADTTTDHKKVTKPVVTTTHAPANHKQMNKPTVSVASNTGHTKQTVVQQTSAHNHTHSNTSYQNVSTETQISTLNVAKHSVHNQVQHNNQRSHHTQQQDVTKPLSNALNNHTVQSQTSHRHKTAAHPSPVAQHTLPATGQTTNHATLWASLVAILGGIMFLIRPKKKHQ

SEQ ID NO: 43109 - protein, 329 aa, Staphylococcus lugdunensis M23590
MMYLDWQRKCIITTIVVLSSFLLVFSSITYASERNTEDSLKITTHNVYFLPTAIYPNWGQSQRADLISKADYIQGQDVVILNELFDHKASNRLLTNLKSQYPYQTPIVGQGTEGWQKTSGSYRKLKKVSGGVGIVSKWPIVQQEQHIYKNGCGADSVGNKGFAYIKINKNGKYQHIIGTHLQAEDPVCMKGKDQTIRQSQMEEIKQFIKDKNIPKDEPVYIGGDLNVIKGSAEYQKMSDNLNVSMPKQYEGNAYSWDTQTNGIANYNYPKLEPQHLDYILLDRDHAQPSSWHNHTHKVKSPEWSVKSWGKTYRYNDYSDHYPVSAYAAN

SEQ ID NO: 43110 - protein, 216 aa, Staphylococcus lugdunensis M23590
MKDNFNEDQKRQQWEQFQEFQKQQEMQKNPKKRKGWLWGCGGCLVLLIIIIIGMSACTATFTGSSGSKNNNSNKTYKVGETAKNGDLEVTINSVENTKQVGPSVAPTNAKGTFVVVNVKVKNKGKDALTIDSNMFKLQSGDKSLEADASGSTSANQAENGEINHSFFLERVNPDSTAEGKIVFDVSDNIANAKDKKIEISSNLLSVKKVTFDLSNK

SEQ ID NO: 43111 - protein, 253 aa, Staphylococcus lugdunensis M23590
MNCKFKYKMNSNLGGYIIMKKTIIASSLAVGLGLVAGNAGHDADASELNVNTKAELAQLAQSNDQSLNEKPVQSGAYDFTFNYEGTTYHFASDGTYFEWQYYPSNGAADDTTMNSQAQQGTMSSSQGAATQQSTSAQPAQTEQAPQSESTQQPQTQATSHSQSSSASQASSHSSVNVNSHLKAIAQRESGGNIHAVNPSSGAAGKYQFMQSTWDHVAPSEYKGVSPANAPEHVQDAAAQKLYDTEGAGHWTTA

SEQ ID NO: 43112 - protein, 2194 aa, Staphylococcus lugdunensis M23590
MKRKKSKQKDYFSNVQNKYSIRKFSVGITSILIGASVIFGANSEAHAAEIKSDDNTQKVVNKEYSDGISQEQQDKSLNLAQDKEKSNNVNKNKVTDVGTSDVLKDTKTAHENVQQQDNVASKEETTKKTPSAIDKNNTSAQSEVVTSSDATKTSTALNQVDRNQLSSQSTSERPKKRVKRDVGTDDKQLVGEFVFSGTNSNERRYNLTSDIVSNRRVTSTSFSYSASGHGTIDNGKLVYEAPKKFIISEPTFSKSEFVTNKTNLSDNETWRYQFDLRPLSGTSAGQINISQVIGGMIWTGPGEGDVVTSTMKMYQGDTLVDTKQVNATFDHIKGGLYIDRGQEKPTSIWRITRKSAAAQSPTIGVIKEDGTISEKTDNYRYQVPLPRDNWFLENRDDAVSPHYYSRYTDFKYNILNIPSWLELDPDAKGNRFWTQDESGIHLHLNEGDILPYNGYTPVLKLKKSALTPELLAKFKTDGFIKVNLDWQTIGRLPNGQDYIQNVPDPEGIKFKMINEAGTATSNVYFMNFRLQEPSHLFSKADHKNEVFRVQKYIYDRDQSNKYAPTYMHSIQLPSGQEGDYFTTFKLSLPRINYNNGSSDKNADKGIVLKAPFILYGVNADGSTTKLNEWTSINNTNNTYGLGDKKYNHLILQTPIIRDTVSPDSEAEKDIYGWEADITYAVDDQRWETAAKDDGVTQMQNGIIINQVAENTLQAASSVPTRALTGNELQPAYSYIHTKDAFKHTLTDVDVRNTNSGLGNVLNYNEKANVIVKADTKDYMKYLSTDPLDNSSDISVDKLDHINHVYLSLSAPDDTAIGNVRAWTNNELIRTSTVWNPSLYETTPSNVLKNRPVLNPIKVIKNYKNSGRTLYIYEAPEGYKWNQSVKNSITERSSITQNTPEITFDIYNRGTLPTGTYSIRYATIWDENSEIVRPTEEQSLSHNNLELSDVITEDLSGNKKFVSVIDVPFKIALAKEYASTLTIGKDASNSFDKSQVDVNLGESVNLQTNTANFTNSEGIIKEIIVTIPKDNIKTNLTALIPDTEKYRVVYTTDTDVRNGVYNSNPTDLTKVTAVKYVFDEPLVLTNGQSFQTNMRVTVPEDAPILTKAHSQILTKGLDNTWLSGNKVELETEDNRGDLVVKYTNESGNTIQNSLTSKGKKNTEYNVSVPQMIDRLNRHYKFVRVDNQLDPTTGHYAKGQTKIVNLIYVEVFEGSVIADYKTTDGEVLSPLVTVVNSQIEGTEYTATPATIPDRVTFETTDDGKVKKTISYHLISTPENQSGTVVGKQTIEVHYVYEPITTYEQIPNDAPQETPVALEVTRYVDSEGNEVQETEEGTHDAPGIIADKWQYTGQTAAENGITTHVYQRIQSEIPNEAPQETPVALEVTRYVDSEGNEVQETEEGTHDAPGIIGDKWQYTGQTTAENGITTHIYQRIQSEIPNEAPQETPVELEVTRYVDSEGNEVQETEEGTHDAPGIIGDKWQYTGQTAAENGITTHVYERIQSEIPNEAPQETPVALEVTRYVDGEGNEVQETEEGTHDAPGIIADKWQYTGQTAAENGITTHVYQRIQSEIPNEAPQETPVELEVTRYVDGEGNEVQETEEGTHDAPGIIGDKWQYTGQTTTESGITTHVYERIQSEIPNEAPQETPVALEVTRYVNSEGNEVQETEEGTHQPPGIIGDKWQYTGQTTTADGITTYVYERIQSEIPNEAPKETPVQLEVTRYVDTDGNEVQETEEGTHQPPGIIGDKWQYTGKVTEKDGITTYVYERIQSAIPNDAPQETPVQLEITRYVDGKGNEVQETTEGKHEPPGIIGDRWQYTGQTTTADGITTYVYERIQSEIPNEAPQETPVQLEVTRYVDITGNEVQETEEGTHQPRYIIGDKWRYSGVTVTENGITKHVYERIQSKVPNDAPQETPVQLEVTRYVDPEGNEVQETTEGKHQPPGIIGDRWQYTGKVTEKDGIITYVYERIQSEIPNNPPQETPVQLEVTRYVDPEGNEIQETTEGKHQPPGIIGDRWQYTGKVTEKDGITTYVYERIQSKVPNDAPRVDIDELKITIYVDTNGREIVPSRKGQLPPEQFIGQDWQYTGHKIEKDGITTYIYKKVENAVPAKQLKKTKHNTQSESQFKHTPQVKQQLVKYHNVKEQRSIEKSEHTDMHVSELPETGETANKNGLIGGLLIAIGAFFVTKRKKENTK

SEQ ID NO: 43113 - protein, 688 aa, Staphylococcus lugdunensis VCU139
MKLTKKEKFSIRKHKFGVSSILVGSIIGLTMLMTKEAEAEEVERNLSKQQIQHNNDATGDTQDDNNYNNEISNQEATTQNKQITQSDNVNSEAQAINEISDSHRTVNKATEALDNNSTLNTSTDVSPATKQDTTTSNQTTQENNDATTQTKTNYKQDGNNNVLSQVATNDNQSSNQPRNSHLNTSTVTYNNNHQVRRLAKVEATNTDNNVTQTSDISNKLSNVTATIEAADTIYPHKAEYVNLNYRFQAPDDVQAGDSIKITIPQALNLNGVTATAKAPNIMAGDQILATGTIDEEGNLIYTFTDYVTNKNNITGQISIPGYIDPKNVTHTGKVNLETSIGQTTAKKTVTVDYEKYGEFRNLSIKGTIDQIDKVNNTYRQTVYVNPSSDTVVDPYLRGGSIPGTNSNVIIDEQNTSIKVYKVKEKAHLTDSYYVDPSNYEDVTSDVKITFPEKGIYQINFNTEDDQINSPYVVVINGHVDPNSNGNLYLRSTLYGYDSNFTRVSMAWDNEVEYHAGSGNGDGIDKPVIPDQPGDSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSDADSDSD

SEQ ID NO: 43114 - protein, 130 aa, Staphylococcus lugdunensis VCU139
DSDADSDSDADSDSDADSDSDADSDSDADSDSDADSDSDADSDSDADSDSDSENDNVSVEVDNNSNQRGISTMKAQHQHHDSNNTTQKNADKSLPKTGEQSEQIGFISSILLFLGGLLFLNRRRSKKEDK

SEQ ID NO: 43115 - protein, 1453 aa, Staphylococcus lugdunensis VCU139
MKRKKSKQKDYFSNVQNKYSIRKFSVGITSILIGASVIFGANSEAHAAEIKSDDNTQKVVNKEYSDGISQEQQDKSLNLAQDKEKSNNVNKNKVTDVGTSDVLKDTKTAHENVQQQDNVASKEETTKKTPSAIDKNNTSAQSEVVTSSDATKTSTALNQVDRNQLSSQSTSERPKKRVKRDVGTDDKQLVGEFVFSGTNSNERRYNLTSDIVSNRRVTSTSFSYSASGHGTIDNGKLVYEAPKKFIISEPTFSKSEFVTNKTNLSDNETWRYQFDLRPLSGTSAGQINISQVIGGMIWTGPGEGDVVTSTMKMYQGDTLVDTKQVNATFDHIKGGLYIDRGQEKPTSIWRITRKSAAAQSPTIGVIKEDGTISEKTDNYRYQVPLPRDNWFLENRDDAVSPHYYSRYTDFKYNILNIPSWLELDPDAKGNRFWTQDESGIHLHLNEGDILPYNGYTPVLKLKKSALTPELLAKFKTDGFIKVNLDWQTIGRLPNGQDYIQNVPDPEGIKFKMINEAGTATSNVYFMNFRLQEPSHLFSKADHKNEVFRVQKYIYDRDQSNKYAPTYMHSIQLPSGQEGDYFTTFKLSLPRINYNNGSSDKNADKGIILKAPFILYGVNADGSTTKLNEWTSINNTNNTYGLGDKKYNHLILQTPIIRDTVSPDSEAEKDIYGWEADITYAVDDQRWETAAKDDDVTQMQNGIIINQVAENTLQAASSVPTRALTGNELQPAYSYIHTKDAFKHTLTDVDVRNTNSGLGNVLNYNEKANVIVKADTKDYMKYLSTDPLDNSSDISVDKLDHINHVYLSLSAPDDTAIGNVRAWTNNELIRTSTVWNPSLYETTPSNVLKTRPVLNPIKVIKNYKNSGRTLYIYEAPEGYKWNQSVKNSITERSSITQNTPEITFDIYNRGTLPTGTYSIRYATIWDEKSEIVRPTEEQSLSHNNLELSDVITEDLSGNKKFVSVIDVPFKIALAKEYASTLTIGKDASNSFDKSQVDVNLGESVNLQTNTANFTNSEGIIKEIIVTIPKDNIKTHLTALIPDTEKYRVVYTTDTDVRNGVYNSNPTDLTKVTAVKYVFDEPLVLTNGQSFQTNMRVTVPEDAPILTKAHSQIFTKGLDNTWLSGNKVELETEDNRGDLVVKYTNESGNTIQNSLTSKGKKNTEYNVSVPQMIDRLNRHYKFVRVDNQLDPTTGHYAKGQTKIVNLIYVEVFEGSVIADYKTTDGEVLSPLVTVVNSQIEGTEYTATPATIPDRVTFETTDDGKVKKTISYHLISTPENQSGTVVGKQTIEVHYVYEPITTYEQIPNDAPQETPVALEVTRYVDSEGNEVQETEEGTHQPPSIIGDKWQYTGQTTTADGITTYVYERIQSEIPNEAPKETPIQLEVTRYVDGEGNEVQETEEGTHNAPGIIGDKWQYTGQTTTESGITTHVYERIQSEIPNEAPQETPVQLEVTR

SEQ ID NO: 43116 - protein, 539 aa, Staphylococcus lugdunensis VCU139
MNSEGNEVQETEEGTHQPPGIIGDKWQYTGRVTEKDGITTYVYERIQSAIPNEAPQETPVQLEITRYVDGKGNEVQETTEGKHEPPGIIGDRWQYTGQTTTADGITTYVYERIQSEIPNEAPQETPVQLEVTRYVDITGNEVQETEEGTHQPRYIIGDKWRYSGVTVTENGITKHVYERIQSKVPNDAPQETPVQLEVTRYVDPEGNEIQETTEGKHQPPGIIGDRWQYTGKVTEKDGIITYVYERIQSEIPNNPPQETPVELEVTRYVDGEGNEVQETTEGKHQPPSIIGDRWQYTGKVTEKDGITTYVYERIQSEIPNNPPQETPVQLEVTRYVDPEGNEVQETTEGKHQPPSIIGDRWQYTGKVTEKDGITTYVYERIQSKVPNDAPRVDIDELKITIYVDTNGREIVPSRKGQLPPEQFIGQDWQYTGHKIEKDGITTYIYKKVENAVPAKQLKKTKHNTQSESQFKHTPQVKQQLVKYHNVKEQRSIEKSEHTDMHVSELPETGETANKNGLIGGLLIAIGAFFVTKRKKENTK

SEQ ID NO: 43117 - protein, 309 aa, Staphylococcus lugdunensis VCU139
MKKHQRTQTNKFGFIANHYSIRKFSVGTASIIVGSLLFLGNPAHAAEANTTQNEPATHQENKVETNIDPIIIDQPQNQAATTNQTPKTEQNHTQANKQLAKSNQAAAVTSDSKSQNDAQASPKQSSTSKQDAVKQQATQANTKAPAQPATQQTREAQPVVRSVKSATSETTEDFEFQVNKDKTKQKSTMNQYMNHPGKLVHANNKYYFEAELNHAKWWKSFEFYDENNNKLNTVVTKDDTSKNIKTIRVEVASGTQQLISKVHIIVPVINYDHEYTTQIAFAKPVPQPAKAQASKAQALDVQSTQKNDC

SEQ ID NO: 43118 - protein, 347 aa, Staphylococcus lugdunensis VCU139
MYNQLKKMTVKPETLAQAKNVARPSVMTLSAKKPASQQAKSAAVTQTAKYKVQKDKSTETSVMDGYMEHPGKFIKENGKTYFEVTLKNADWWKSFQFFTPQNKELTTTVVKHDKKADTKTIRVEVKPGMKQLISRVHIVVPAINYDNKYQTTLLFETPVPELTTAKPETPKTKPANKTNKAKTSTTKPTKANKENKANKTKKVDKAKNNAPKVVQPATTVNQHSKAAATHTTIKPSHVSTTVNHDATATQHHTPVVASTYKPAKDEVKAQATMAQPTTQQHVHLSQNKHEDKQHVAMTKPQPAQQSHMHSLPNTGQENATTSASIFGSLLALGGSILLFGRKRKEQR

SEQ ID NO: 43119 - protein, 690 aa, Staphylococcus lugdunensis VCU139
MKNNHENNNARPNQHFSIRKFSIGAASITLGTCLFLNAEHQAQAAENAVEPAHSAVASENNTPAQSKPVAPTVETNAQPNADHTDKTVATTTTNDKSRAQANDKQTVTPATNVSNTTQPKAAPAPTALTTNAVNPKSSTAVSNPAKQAVDQSIKDAVKDKTYTNKPHDTSNSRPVSFEMKNKDGDLQFYHYASTISPANVYFNKDKNKTTVELGLKTASTWKKFEVYENNKKLPIELVTYNPETDDAYIRFDVSNGTKELVIKSSTQIYNDPETNYDYTKMVFEQPIYNDESKFKTREDFETEALLADYNKAKTLERKIYELNRVKDQLPEKLRAQYSQKLEQLKKDLDQEVASAKVEFEHAPVKKVQITNSKALDISVLQSDDDDLSTMDGFVEKPFELVEVDGKKYIKLTTTIDSIWKDFQVEGQRVMTIDKDTVNDKRTVLFPYVEGKEIYNSIVKVDFPTIGYSGQYHVRIKNNAISKKADAEAPTTPNNKKDAKPDINQADTATSNNKKADKPIVKPADTTTDHKKVTKPVVTTTHAPANHKQMNKPTVSVASNTGHTKQTVVQQTAAHNHTHSNTSHQNVSTETQISTLNVAKHSVHNQVQHNNQRSHHTQQQDVTKPLSHAQNNRTVQSQTSHMHKTAAPLSPVAQHTLPATGQTTNHATLWASLVAILGGIMFLIRPKKKHQ

SEQ ID NO: 43120 - protein, 329 aa, Staphylococcus lugdunensis VCU139; identical to SEQ ID NO: 43064

SEQ ID NO: 43121 - protein, 235 aa, Staphylococcus lugdunensis VCU139
MKKTIIASSLAVGLGLVAGNAGHDADASELNVNTKAELAQLAQSNDQSLNEKPVQSGAYDFTFNYEGTTYHFASDGTYFEWQYYPSNGAADDTTMNSQAQQGTMSSSQGAATQQSTSAQPAQTEQAPQSESTQQPQTQATSHSQSSSASQASSHSSVNVNSHLKAIAQRESGGDIHAVNPSSGAAGKYQFMQSTWNHVAPSEYKGVSPANAPEHVQDAAAQKLYDTEGAGHWTTA

SEQ ID NO: 43122 - protein, 291 aa, Staphylococcus lugdunensis VCU139
MNKIQSWLSKYKIKNKPTMIALIPFILFLILLFLFLNHNDQKSDRITVVENSELRTGPNAAYPVIEKVDKGEGFTKINQTGKWIEVQNRQETKKGWIAGWHTSLNIKKDVSQSQEPLKGKTIVLDPGHGGSDQGASSRTNKKSLEKNYTLKSALELKTLLEKEGAHVKMTRSDDEYVKLEDRKASGDIFMSIHNDSLESSVANGATVYWYKDSQSKLAETLNASIQKKALLSNRGAKQENYQVLRQSKIPAVLLELGYISNPTDETMIRDQHHRHIVLEGVVDGLKQYFAS

SEQ ID NO: 43123 - protein, 198 aa, Staphylococcus lugdunensis VCU139
MKRLFSLLLISSLVLTACGSKSHSESNSSEKKSSESKSATDKSESVDSCLEKAKNKPTAKFKDNKFTSNKFDIEIKETKVVKPDKYTDSKNPNLAIVYKVKNKSSEKITASTAFIEAFDVYNDTKNVQKRLETGFAEDSDLYKKYGEDMRNNINKDGEVTGVRFFEIKDDKKPITIEAKNPDGYTTKEIGKKIIKLEH

SEQ ID NO: 43124 - protein, 277 aa, Staphylococcus lugdunensis VCU139
MKFYQQQRFGIRKFAIGIGSVALATVVFLGANQDAYASETSRTATEQNQSHAQHQANTQNQHTSGKHTSEVDITSPYGKTTDIIEKNNSNQNSSSHSKTEIILGSTDGEWLINDITIINSETHHTSQNNHSSHNIKTEKQSTSKKIQHTGSSVKTVSQQRTSQSRLTKQAVQHQSQKQNVEKHSKIVNPSTAAVNVEQPFNPSQHNELNHTHQTLINQTKKPTVTHATSSNMTVTAPINHKALPNTGKEETPEHSMALASILAVLGSALFMRRRKHI

SEQ ID NO: 43125 - protein, 2988 aa, Staphylococcus lugdunensis VCU139
MKSNKKPAQFLNRHNNYSIRKFTIGTASILVGTTLIFGLSNEAHAQSNSSAKVSDKVATEQSASTSQEADSSQQTAASNAQNVQTAPEQDKATPTTEVNSNNNQTDSKHVAPQKEQNQTATQTESKKETAQTQAKTEEKAASDSKKASEDSDDKATSKETDENKTDDSVDTNSNITTPVYDTTRARAATSVPLASSLDSDASAAENAEPPAEFIDKYNKSTNRSQLVHDLLAESYSETDVRAIVNRLNIDFNKTDAKKAFQAIMYAGIQYAKEQTSLYTTYATIPGDGVNVNNTEIGSVAELKRSIYIDPNKGLTVNGQGYTSQGQSPANYTVHVQPNKRTNKMDFTVTWKVNPSASASGHDADLGGFNFGSGYNVPERINGRFNIYGGNTISNNLDMIKSPHPSYPAGYGLSSRPTITRYFVQRGGRVEYHFSVPVRDWNGDLSFNGKVLMFDNNVTLVGQGVMNPNSNDNYFYDEMNIQGDNNPDRHIITTDDTSEVENIPFQIEYVVSKDLPVGQQEVQREGQVGKRGTLYSIVKFNNQTIGRFVKETYNIPPVNKIIKIGIGAVNDSNISGPLPPILEPQLSGTNIVSGETSPNAAVTITVGGRNYQTTSDNSGRFNFQLPNYTLQEGDHISAVATVEGKTSKPGKIIIPRDGRTPNLTTSVQRGQDQNKPGSWVTITNATTGQQVSRFFVPDGLPGNDGRSITITNEYLDPSTGERVVQFSDGRTIRLPKGPKGDKGDTGAQGPAGRSITITSTTVDADGNTIVRFSDNTTLKIPKGPKGDKGDQGPAGKSITVKHISKDSQGNTTVQFSDNSSIIIPAGTPGRNGTSVGIRTITPQANGDTVVTFTDGKTMTIPKGAKGDKGDVGAKGADGHSITITSNTVEPNGNRKLVFSDNTTVVIPKGDKGDRGENGQNGTSISITSTGTDTAGNTVVHFSDGKSVTIPKGQNGTSIGIRTITPQANGDTIVTFTDGKTMTIPKGAKGDKGDVGAKGADGRSITITSNTEEPNGDRKLVFSDNTTVVIPKGVKGDKGENGTSISITSIDTDTTGNKVVHFSDGKTLTVPKGQDGTSIGIKSITTSANGDKVVTFTDNQVLTIPKGDKGDKGDNGQDGHSITITRTETDAAGNTIIHFSDGKNVTVPKGQNGTSVTIQNIAKQPNGDTVVTFSDGKSITIPKGDKGDAGVKGADGHSITITGNTQEANGDRKLTFSDNTTVVIPKGDKGDKGDNGQNGTSVSITTIDTDSTGNKVVHFSDGKTLTVPKGQDGTSIGIKSITTSANGDKVVTFTDNQVLTIPKGEKGDRGDNGHDGQNGRDGASITITRTETDAAGNTVIHFSDGKNVTVPKGQNGTSVTIQNIAKQPNGDTLVTFSDGKSITIPKGEKGDAGVKGADGHSITITSNTEEPNGDRKLVFSDNTTVVIPKGAKGAKGENGTSIGISRTEVDGSGNTVVHFTDGKVITIPKGQNGTSVGIATITTSSTGDKVVTFTDGKTLTIPKGEKGDRGDNGHDGTSITITRTETDGNGNTVIHFSDGKNVTVPKGQNGTSVTIQNVTKQPNGDTVVTFSDGKTITIPKGEKGDAGIKGADGHSITITSNTEEPNGDRKLVFSDNTTVVIPKGAKGDKGDNGQNGASITITRTETDAAGNTIIHFSDGKNVTVPKGQDGTSIGIKSITTSTTGEKVVTFTDGQILTIPKGEKGDRGENGHDGQNGRDGVSITITSTTTDGAGNTVIHFSDGKNVTVPKGQNGTSVTIQNVTKQPNGETVVTFSDGKSITIPKGEKGDAGVKGADGHSITITSNTEEPNGDRKLVFSDNTTVVIPKGTKGDKGENGTSISITTIDTDNDGNKVVHFSDGKTLTVPKGQDGTSIGIKTITTSTTGDKVVTFTDGKSITIPKGDRGENGQKGQDGQSITITSTTTDGAGNTVIHFSDGRNVTVPKGQDGQNGTSITVTNTELDKDGNAVVHFSDGKTVTIPKGAKGDRGENGHDGQNGTSISITSTTTDSAGNTVIHFSDGKNVTIPKGQDGHAIDIQSVTKNPQGDTVITFTNGKTVTIPKGEKGDRGENGHDGQNGTSISITSTTTDSAGNTVIHFSDGKTVTIPKGQDGTSVGIQNITKQPTGETVVTFTDGKSITIPKGDKGQDGKSITIISNTIEPNGDRKVIFSDNTSIIVPKGDKGDHGENGHDGTSVTVTNTTTDGDGNTVIHFSDGKTVTVPKGAKGDKGQDGTSVTLTNTTTDGDGNTVIHFSDGKTVTVPKGAKGDKGQDGTSVTVTDTTTDGAGNTVIHFSDGKTVTVPKGAKGDKGQDGTSVTVTDTTTDGAGNTVIHFSDGKTVTVPKGHDGQNGHDGTSVTVTNTTTDGDGNTVIHFSDGKTVTVPKGAKGDKGQDGTSITVTNTTTDSAGNTVIHFSDGKTVTVPKGRDGQNGRDGHDGVSITVTNTTTDGAGNTVIHFSDGKTVTVPKGQDGHSVSIQEITKDAQGGTIVKFTDGHSITIPKGDKGDRGEKGQDGQSITIVSQRVTKEGNTIVEFSDGHTITVPRGQDGHSVTVKESHKDQSGNTVVVFSDGNTITIEKGRDGRDGQDGKSITIVSQRVTKEGNTIVEFSDGNSITIPRGKDGHSVTVKESHQDQSGNTVVVFSDGNTITIEKGRDGRDGRDGRDGRDGNNGQNGYNGNNGYNGQNGYNGQNGYNGKDGQSIHIVSQKLTKDGNTIIEFSDGHTITIPGGQNGHSVTVKDIQKDQSGNTIIIFSDGRKVVIEASKQIQKQDVKPTPSAVKHYYIDQDKNTVIILADGREVCVPCIQGTRATIKYYYIDQAGNVHIDFNNHPSIVIPRKPIEITKTHQHTNHQSYNHQHQDFNGGYNNYHNHYKGQHDFNGQHSHHGVNNFVGHQGNAGHQHYSHYENYTHSQYDHGQAHANYAHQAVQHQAYNRHVSYHGYGYTMTEAMAQYRDVVTKRYALPETGETTSLSLAYLMTLVGSILLLSAFRRKNVK

SEQ ID NO: 43126 - protein, 233 aa, Staphylococcus lugdunensis VCU139; identical to SEQ ID NO: 43060

SEQ ID NO: 43127 - protein, 190 aa, Staphylococcus lugdunensis VCU139
MKQMVQIILSVFALFLVLTATSVCVTQADTMSQQDAITTAKQAIARSGGNPDLQNFNTVIDKGNYFKIKITLKTNDSVGTYKVYKNGQVEYKNGKFGVYNLLNPNQTYAASEIANTSTHMAQQEQQNNPVDCKKELNRYYVGNIKSTELPQQNASLPETGHTSNNIITLAFGILALMSGLALTFMRNSKH

SEQ ID NO: 43128 - protein, 2190 aa, Staphylococcus lugdunensis VCU139
MTNRKRNSSQRMDFIPNKLNKYSIRKFTVGTASILVGATLFLGHHEAEAAEKQQSISQNHSDKQESSQADTTVTTEQTTNNNVSSQTNATSPSTQDKTTIDHTENPSSTNQQITENQSLHAKDLQTSNQNNVSHKDTANKSTEKEARQHQNHKSTIQQQESSEKLVTAAQNASATNQAVSTNTNETHVQYADKKLSQIGVNHQTKEQVKASLVTKKAFKPRSKRDLDNTIVAETLKADITNPDYGVRTPATPVTAAASTSPTTRALSSNYRVRALAAATPTGKDVSDKIKFSNIDIAVEGRTAHTNASGQRELWVTSGDILSLKADYTVDNSVKSGDTFTIGYGQYIRPGGFSLPSSDTELRDANGAIIAKGKYDSNTNKTTYTFTNYVDQYDNIQGSFKIAATAKRENAINDKGSYNMDVKIGNVSFNKNIIVDYGDNKNNPLNASTLYRDPKTNQQYRIIYINEPGKTYKNVKYHSTTMNGKLIDGTDAIKVYKVNDPSAMVNSFAPDLTSSKVTDVTSSKTITYDNNRSTVNVSLGNLDGKTRYIIAEKVEPTTDNGNLSSTFSITNDDKNNPTIWAASTTQGAAGDNSTGSGQQIGKYSLGDTVWNDKNRNGIQDIGEEGIPNVYVTLKDANGNEIDRVTTDENGNYKFKNLKNGEYTLEYSTPNGGYSLTKADQSNNDAVDSDAQLVNGKYVAKATIQDDDNMTVDAGFYKSVYNIGDFVWNDTNKNGIQDDGEKGLAGVTVLLKNEQGRTIATTVTDKNGKYGFYELESGNYTVQFITPDGYILSPSKVGTDVTKDSNGDEVPIKLTENDYSNDLGLYKPDAPKLDDYEITVEDKSYENTVRVNTKLPKNTIQLAQQGKDGRDRVYYKQLGYHPDLTGKDASKLLQIDGYYFEEVRRDHIYQSQDAIFEYNLDNNTGVKNITYNPTTNTYTVTYQDGSTKELPGQQPKGLTINNSYINQNGDTIVEFSDGTTITIPKGKDGVDGKKGEDGKTPKIEQTPITDSSGKQIGVTITVKDGDGKVINTQKVLNGQDGAKGNPGEKGEKGDPGTKGDKGEKGDTGAAGRDGQNGQDGKSVIANTERGTKDGQEGAYIRIYEVNPDGSRGTMISETFIKDGVKGQDGKDGRSPSIQQTPIKDEKGKIIGTTITILSPDGQEVSHQDILNGKDGQNGTSVTTITERGRQNDQTGAYVRTYERNPDGSRGKLISETFISDGQNGKDGQNGMNGKSITAETRPGTDADGNTGAWIRVYELNPDGTKGQLISETFIKNGAKGEKGEDGKTPKIEQTPIRDSSGNQIGVTITVTDGDGNVVSKENILNGKDGAKGENGKTPSVEQQAIQDKDGKQIGVTIIIKDGDGKEISRQNILNGQDGKNGTPGKDGQTPTVETMPALDKDGKQIGVTIITRDGDGKEIGRQTVTNGQDGKSITAVTARGEQNNQTGSWIRVYEVNPDGTRGKLISETFVADGQKGADGKNGVDGKDGKTPTIEQQPIRDKDGKQIGVTIIIKDGDGKEISRQKILNGQDGQKGANGQDGKSVTAITERGTQDGHKGSYIRIYEMNLDGTRGKLISETFIADGEKGRDGVDGQDGKSVTAETTRGDKDGQTGAYVRIYLTNPDGTRGKLISETFIADGQKGKNGQDGKTPTIEQLPILDKNGKQVGVTVIVKDGNGKEISRQDIYNGRDGQDGKDGKTPSIEQQPILDKNGKQIGTTVIIKDGNGKEISRQDIHNGQDGKTPTIEQVPSLDKEGKQNGIIVIIKDGDGKEISRQTILNGQDGRDGGDGKAPHVEQQPILNKDGKQIGITVIIKDGDGKEISRQNIYNGEKGKDGKDGKDGVDGKSITAITERGTKDGKSGSYIYIYEMNSDGSRGKLISQTFVEDGKDGKTPSIEQQPVKDEKGNQVGVVIIVKDGDGKEISRQVIVNGKDGQDGKTPSIEQQPIKDENGKQIGITIIVKDGNGKEVSRQNIYNTSNITNIYVNVEGNIVFVFKDGTTCICKCEPNKPNEPGKPSEPGKPNEPNKPSEPGKPSEPGKPSEPGKPSEPGKPNEPNKPSEPGKPSEPSKPSEPSKPSEPNKPSEPGKPNEPSKPSEPNKPSEPGKPSEPSKPSEPGKPNKSVHTSTTKHVNYKTTSHIQQVHDTTQSNNDKKQQELPATGAVDDNGYQAPFFGSLFAISGTILFLARHRKHHHQ

SEQ ID NO: 43129 - protein, 437 aa, Staphylococcus lugdunensis VCU139; identical to SEQ ID NO: 43050

SEQ ID NO: 43130 - protein, 2031 aa, Staphylococcus lugdunensis VCU139
MKSKSNKNLGLSPIKQNKYSIRKFKLGAASVTVASLLIFGTAGVAKAAEVHGADKAQQAEHVANVAKSDTAKATEAPPAASTQQNEVKTSEAPNTAKAVTDKEAITPTAAPKEDKVVSDKATTQDKKETRGYKANNTEPQKGTNAIANTGKHDPRNGQAIPGYGTSSFRDGGNTVSIDGGKITASGHVNVDDRVNTTTGISYDYTLNFKEGVFHEGDTFKIGIKELGEDTRLPKELKADDGTTFAIRDSYKSLYNNPNTNQIPFFSQRNPGTIDEKRSWHLQSRGTFLEGVYKFTKEVEKLKNLHFSFSNKDGLRFPEVTKDKRVTGAILVNDQVIASKDYTVVGQAISPAPVNLNKAVIDTSGDINIDKDGTVKSKWENLRLNTNGKTFTTNTTFTVTLPDTGMNSFEKVGDFNETGVMIVEVASNASNSVANENDVVLKAPKEDPSRIAKVRVESVQPNKLVFKLVSGQLDPNKVYVFLLKNMGVERKVNSTTLNYLSPDKSSISEQGATFEVTKDGQRLTDTYTTTAGVNWNVVGDRTKLNTGASLAFYDVTSRYIDGSGNLLISADPAVEHGLASVDEFNTHNPQPNFNEAQVGNPDNSHATITTTNGSNKKITDITPPYLIKKDGKYYVFNQYLTKSNYYQNTRTSGTIEHSPVNVVAQYANAKFGTVSVGYEIKDSNEKLKADEVIRDGSAQLTNIVGNQYTVPSDKVPNTIEKDGILYVLSKVPADAPSNATGQIAETPTRVVYKYTNAYVSVTPENPGHPGQPIDPNNPSIVWPRYTDLASLTKSVTRTIKYVDAENTSKVLHAPVIQTVKFTRTPIVNVVNGRIVGYDEDGNGTIDTTSAENAWVPENSGATTWPEQTSPKANELTEQGYHETTTPSVAAVSVNASTISTEVLVKYQRQDKEKYEPTPGQINHDYGTPTTADEVKNSVKVPGYPTSVGTPTITVDNPNQIPNGQTPGTVVIPVTVTYPDGSKDKTTVTVVTGNPLKDAYEPSTKPINKPFGTPTTADEVKKAVTVPDYPSSKGTPEVTIDDQSKIPNGQTPGTYTVPVTVTYPDGSKDHANVTVNVGNPENSTYEPHVTPINKPFGTPTTADEVKKAVTVPDYPSSKGTPEVTIDDQSKIPNGQTPGTHNVPVTVTYPDGSKDHVNVPVNVGDPDSSRHEPKVTPITKDFGTPTTADDVTKAVIVPDYPSSKGTPTVTVDNPSTLPNGQTPGTYTVPATVIYPDGSKDHVNVPVTVKEQPDKDKYEPKVTPVTKDFGTPTTADEVKKAVTVPDYPSSKGTPIVTVDNPSTLPNGRTPGEYTVPVTVTYPDGTKDHVNVPVKVGDPDSGKYEPKVTPITKDFGTPTTADDVTKAVTVPDYPSSKGTPKVSVDNPSTLPNGQTPDTYTVPVTVTYPDGSKDHVNVPVTVKEQPDKDKYEPKVTPVTKDFGTPTTADDVTKAVTVPDYPSSKGTPKVSVDNPSTLPNGQTPGTYTVPVTVTYPDGTKDHVDVPVTVKEQPDKDKYEPSTKAITKPFGTPTTADEVKKAVTVPNYPSNKPTPEVSVDDSSKIPDGNTTGTFTVPVTVTYPDGSKTHVDVPVTVKEQPDKDKYEPSTKAITKPFGTPTTADEVKKAVTVPNYPSDKPAPKVSVDDPSTLPNGKTPGEYTVPVTVTYPDGSKDHVNVTVKVGDPDSGKYEPKVTPITKDFGTPTTADDVTKAVTVPNYPSDKPAPKVSVDDPSTLPNGKTPGTYTVPVTVTYPDGSKDHVNVTVKVGDPDSGKYEPKVTPITKDFGTPTTTDDVTKAVTVPNYPSDKPAPKVSVDDPSTLPNGKTPGTYTIPVTVTYPDGSKDHVNVTVKVGDPDSGKYEPKVTPITKDFGTPTTADDVIKAVTVPNYPSDKPAPKVNVDNPSTLPNGKTPGTVYVPVTVTYPDGSKDHVTVSVTTRPNKPSESVQPVQPNEPVQPAKDATPLVDGNHVTVDTQNHAKTATNQSTLDNKHQAPAKASEQKSLPDTGQKETTNTTLFAGLFAALATAMFVSRKRRKDNK

SEQ ID NO: 43131 - protein, 1444 aa, Staphylococcus massiliensis S46
MKKSKKNRVLPKKVNHYSIRKFSMGTASIMLGATLLFSIDKQAEAAESPLTSQGENKADVGDGDKPPETSTETPVVAPTEAPVETVIQNNDNPNIELEGVTIETPDKAVESAEADTTTDATATETTTAEETVAADETTPPSSTEPETEIVSDEPSQTEEITQPTETTSSDSTSETSTESEAKASEPSTTENEITPPTTDDQSTTSQNTTNQDDTTSTETESKDVSIEPEPTIISEEPSSTEEITQPAQTEETSTTDATNEASKESTTETSDEATSPSSTETESQESNTVSVTEASEKPQSETDSKVEETPQAQLVSESPETTEASQATNEADTAQSETSDKTNEAQTADSTSTEPTQESTTEASTTSDKTEATTFTESPRDTEDTSEVVVTEAMTTDSKQSEQTQNSENADTSSTNETEYQVEETPQAQLVSEEPETSQASSEDVKAQSEATNVTTDEKASTDSMVSETSQTTGEKIETTSKESADASTQSEDTTQVEETTSTESLASTTETSQSEDTSQVEDKASTETTTSETSTDTQASTEDQTASSEKTETTETPTSNDSAFQEEATTTPSTEDVTESSAITSESAPQTEETSVNTDAVASNEESQTEAAPVVESMNTVKEADATSEASTSDNTVDPATVDANKADLTEALETSDSKTEAVNDYLTSNLNEAEAAEVQSNIDPSVDLNTASTEEIQAAVDQAVLKTVADDIESNQLPKTTVRSMSTMTYAGVAAVDANTTTTTADLPYSENYTFQTIMFDPQPLTSDQVLKGNTIPFEIHDYMTGSNSGDRYKVDLQLDPVIADHVTRITVNSANQNKQREFTRLKDADGNLTDTWEVNFIRANNGLFGGVEILKPYTATGGKIYLDDTVGNIVNSTDVTLDKLDYRIYVRDSETNTIIKTADTSGYFVTKDNYVANLPTSTSTTLNNQFKASNGSVKYEDTIGNNGGFIVDQTIMKNGIFDYNVSANTGTGTKQFSYNYMIDPDLIPYIDHVKLHRLDFQGVTGFDQNYYPANKVADLKLNADGTGSITDADMNKLIEFNNSTPESVGIRMVVVLNQDINNILTKDGQYDENGNLIIGTSDIKEDFNFSGYLADKNGGVINNTYGNSTLFLQDADQDGLLDSYEKQVTHTNPSVTDTDNDGKNDGDEVKNYQTSPLVGIPEVPNMAVGDTVVKGTVPLAPNLNETQTVNIVDQNQKVIGTSTVNADGTFNVTIPSSPEGQYHVQIVSPSYVNPEVNTFEIINYETALQTEISPVNDQDTTITVEGHPGSTVTVKASDGSIIGTTVIPEDGTSGVVQLNEPLAAGTVITSTATLDNHTGQPSNPVTVSDVTAPSAPVINPVTSEDTSVTGMAEPNSTVTITYPDGSITTVSTDENGNYTSEIPDSVNLQGGETISATSTDQAGNESEETATTVTDTTMPEAPTVGPVTSEDATIIGTSEPG

SEQ ID NO: 43132 - protein, 645 aa, Staphylococcus massiliensis S46
MSQHQRFSIRKYKKGIYSALLGTTILLGGNYVAEAEETTNSTVPDQNNEYVHAHTIKGHEGEVVNQPIIEAPNYAGDNEATFSFKEGQDTHGLNINKTYIEGTLTTPTDLKPLTIRATKKDNQEEFLEYYVRVNEALKLFEPIITNDITTQSTFIRGTSEPDTTVNFFYNEKGNQVTKHTRPLLDANQSPLSTVTNSDGTFNVDYDFSNMEDASFYAVASKTGYKYSEPSNIVVVYNEFKLKINQLDKEGLKAYLKEINDQFSALKTIVEAEKNNPNSSAISDDTLKKLQTLFKNAQELKAAIDKKEAEETSQPIDFSKMTKDELKGYLVEVNKQFELLKSLAAEDLKNGTTIVNNKETIEKLVKLRDKLLELKAHVDKQESEANQENTKPEPKDLSKMSKDELKAYLVEVNKQLELLKKLAEEDLKNGTTIVNNKETIDKLLKLHDQLVKLMTEVEAREAKAGDKPPVEDKEIDWKGLLKELEMNLDGLNKEEALKQLTLLKEKFAKFKALVEQEKVKADSSVFNDDFYEALLKLEANYAESINQYLKANHYPKDPANPLQFMPEVKKKDNADTVVTPLPTSVNTSHGSEDSTPSKAKSAKAQQAQKMLPQTGEFDHQKLINIGMISLLVGGSILLSYRSRKHN

SEQ ID NO: 43133 - protein, 3071 aa, Staphylococcus massiliensis S46
MRHQKIQRFGIRKYNVGLFSTVIGTLLFLGSQSTAFADETTHRESNVIATTIHESESDKEEADTPKPEEAITPLESETSDDTNTLNVKDEVLDYESKTETESEASEDDAKDKVEEKDKKDEETQEEKSEKEAKSDKEDEASKSEESQKEDTPKTEKAKAESREATEDSKPRRRGKRSLEANSLREATPPENNPIRKRSKRATNDPTPTQDRSNRHSFIYGDPNDPRTLMLNDYDHPLNFTDGMDLHLDFNWLNYNENRRRVRNQNGDPYGLKGAGLHQEFVSNTSEILLRYVTFPGNNNYSTNEERLHLSFRQPKFYKNIEAIVIEDGNNTVGFTRNYDGSNWDTEVRQFTSLLRNARTKEVRLKIKLKNGQTLRSLGFTDDIPVYVTSSLEDTRNGIIANSVQNTLITLKQYGGREQQGFPIIDSLNNPSGFFIRPMNSNIVVNRKDKTFMVKHNFQPRGNATTNEQLRYSLLYFKEQLPRELLPFVRPELVELFQTNNNDIEGQEQATGKKAHRFTLDSNGLLDTSQGSKWSIINPNAETLDNFRTAENNWREVLTKNDNSPVSFATRYYLKDNVTFDSMEKALKQSLGFKLLHLDSWFELDQANTKLQTHWPVIDRGSPEKIMKGSYSANFFDFRNLNKDTPPTIDPIANKTVLKDAGIEPIRVRAHDDKVVSRITVTNLPQGLLFDSANNEIHGFPTELGTKTVTVRAYDNRNHETSRTFNITVQKARLEAPTLNPVNNEEWVVTGKAIPGTRVGVKVNGTPLTLNGQPKLVDTDDRGFYSFRLNNRVPAGQIIRAYTTKAGYQDSNDSAPVTVSRGNPPRLTTPTTNSYTDQDPISIDLQAVDDVTEPHRITYSFPPGTNTYGLVIDHNRLRGTANLQMHNQPIQVIISDEVGNTRLETFTMLVSARPQANAPIIDPASANSETQFLRVHGNKFGRIDLYRNGVLYTESNGAPSYAFVSSMSGGWASARLDRKFQAGDVIVAQYPNNGSPPSAPVVVSDKTRPNMSVIPDQEILEGDAYNITLTGNDNYTPANELVYAFEEGQNLHGMRIEGNRIVGTASDPLLTNVSIHVKVIDKGKNENSRTFNLKVNAKPQVAKPTISGDLTSEMNRVTGTTTAGATVTLRNNNVPVVNSNRQPITTVADSNGNFVFNLANRLQAGAQITVTATKARHNDSEISDVKTVSDATFPTYDYIAPIVKTINDPVQISIVGRDNVTTPQNLRYEFEAGQDTYGLTISGQTINGPVTKLTNGTKRIRMKVTDEAGNFAWGTVTLTVNDYPKLAAPTITTNINSETTIVHGTGVVGSTVKLYNGTEVLRDRGNKELAYTIGANGSYRFTLASKLPAGSEVIAVATKTNFRESDASSVDVVEDATPPSTPKAIRVTVTRGHRVNTAITLRDNVTSQQNLRVVLVPNQETHGISISNTHITGTATSVTSPKPIQFKIIDEANNERLASFTLEVREQPHAATPLFSSSINTNTTEISGTSTPNSTVRLKNGPNFITDSNNQPLVATANSRGKFIFNLSQPLPYLASITAIASLPLHLDSLPSRELIVVDKTVPVIDTSNLNDLNLTVGDDISIPLRATDNATSPNSIIFSVKRGSANTQNLTVQNGMLTGIASSPVTNEIVTLVATDGASNSSEHSFRMTVVEQPQLDPPQVNDINSDDLTITGTTAPNATVSVTVNNNPLENSSHDAITAVADATGAFTINLETPIEAYSNVTVSASKTKHRSSDPSDTIVVSDGTAPEYDAIAPINTTRGHEVSQDISSYDNVSQPGNLVYDFANGQDNYGLSIDGGIITGRPNKVTNGDVTVRFTITDEANNIKDGEFTLNVREQPKTPTPSLNNITTETTTVTGSAVIGSTIKLKKGTNYITNSQGQPLTTTTNQNGTFNIQLPNKLVTGDRVVAIASQDLHLDSDPSTVDLVEDKTLPTISPISPIHGRRGYDITPVAISGTDNTTRSNNLVYAFAGNQNTHGLRIDNKRIVGAPNTVLSSPVTLNLTVTDEAGNVGTSTVSFTVEEQPKLAKPTISHDISTVTNEITGTAESGSTVKLLRGNQEVTGANGTPLTAVTNNQGHYAIQLPNTFSTGDNITVVASKNLHLDSDASDMKAVIDRTNPSLNPIANINGMRGYDITPITLTATDNTTSSNDLVYEFVAGQPTNGLSIVNKQIVGVPTIVTPSPVELTVKVTDQAGNFDTKKVILNVVEQPKLVTPTITTNINSETTEVTGRAENGFKIKIKKGNDFILNAQGQPLEVTTNNQGEFRLSLPQKVDAGSNVTVVAFKDKHLDSDPSTVDFVEDATNPTLNPISNINGTRGYAITPVNLTGSDNATSPSDLVYEFVLGQDTNGLQIVNKQIVGTPTSVTASPLELSVKVTDQAGNIDTKRFTLTVAEQPKLSKPVITTNINTETTVVEGTAEAGATVRIKNGSSFVNDNNGQPISVTANNQGRFAINLPQKFNTNDVITALTYKQLHLDSDASNPDTVEDATRPSLNSISNINGMRGYDITPVQLSGSDNTTASNDLVYDFAPGQDTNGLRIENQQIVGTPIAVTASPVELTVRVTDQAGNTNTNTFTLNIVEQPKLSTPIITTNVTSESLVISGTAEAGSVVKLKNGSNFVIDQSGSPIEAVTNASGRFTFNLNDKIDVDSELKAISYKDKHLDSDESAPVIVSDDTNPVFDQIPAINGMRGYEISPVTINARDNKTPSNNLVYEFVPGQNTHGLSIQNNQIVGTPNKVITNPIELSVRVTDQAGKSDITTVSLTVAEQPKLMKPTITTDVNSMTTSITGTGEPGATVHLKNNQQDVIRTNGQPITTIVGNDGSFTLSLPNPLPANSEVTVLTTKDKHLDSDSSDVDHIEDKTPPTLTKPNGILEVNGMRGYDLAPVQLSGTDNVSNSNRLSISFKPGQDTHGLNITNNVLSGTPVKVTQQPITLTLLIEDEAHNVSEDTLTLNVAEQPKLVKPTINGDIDTNSNVITGNADPGALITLYDGNNPLTDSSGNPITGVVAQDGTFNIPLHKPLAPNVALTLKATKDKHLDSDSSDTDQVEDRTNPTLEDINDVTVLKTKKFEFHL

SEQ ID NO: 43134 - protein, 278 aa, Staphylococcus massiliensis S46
MKKLFVASTATAALLAAGIGVNEEAHAGGTNSGQEANTDVQNDGVHKLVWGDTLSELGVEYNASVQELMDWNELSSDLIYAGDDLIVDENVAAQTNHEQEEVAVANQQAAQQQAVAEQQAVAEQQAAEQQAAAEQQAAAEQQAAAEQQAVAQQQAAAEQQAAEQQAAEQQAAAEQQAAEQQAAAEQQAVAQQQAATQNVQIPAHLQTIAQRESNGDPTAINPTSGAAGKYQFLQSTWDSVAPAEYVGVSPAQVPEHVQDATAVKLYNNGQGAHHWVTA

SEQ ID NO: 43135 - protein, 424 aa, Staphylococcus massiliensis S46
MKGKQNINTFGIRKYKIGTFSTVLASVLFIGGLGVANDAQAAEDNPTVKQTDTEKPVVQAIGEQTGKVGEDLKPINVVATDNVGVEGIAVSGLPSGVVYNNENATIVGTPVVQGDFTVSVEVNDKAGNKSDVHQFLLKVAPESKSVSKLADIPFMKVNKGEPIKLVNIYKEGVNLKKILSAKVTGLPKGVTFTEATGIIEDTPTEEGLFTVQVTASLTKDRLQGKSFLIQVGDGKIDAPKITDVVFKDKEGLADIAVSGVPEAYVVIFNQDDVVIAEGLLDTEGKAKFEVTLLGNDKEITAVTYDKDGLESKPSTAVKVDKEKLMKYDDIEDGTFKDMKDSTRTDSIYEAQVKKEAQSGKGSVTDKSTKEAKKESKDMKKDSKEEKAKKMLPKTGLETSSNATVFGIAALVAGAVFLSKRRKEN

SEQ ID NO: 43136 - protein, 147 aa, Staphylococcus massiliensis S46
MSKLKRNGNKNYLPNQLNKYSIRKFSVGTASIIVGATLLFGAGQDAKAAEAVSIEESNKDASSAETPTSTEEPATVENTTTEASTEQPSTEEAATTEVASTEKVSTEQPSTEEKASTEEVLTEQPSTEEKASTKEGFNRTTFNRRES

SEQ ID NO: 43137 - protein, 25 aa, Staphylococcus massiliensis S46
MAGDIIGTINDLIKWIADTVEKYKK

SEQ ID NO: 43138 - protein, 432 aa, Staphylococcus massiliensis S46
MPIITDVYAREVLDSRGNPTVEVEVLTESGAFGRALVPSGASTGEYEAVELRDGDKDRYLGKGVQKAVENVNEIIAPEIVEGEFSALEQVSIDKMMIQLDGTDNKGKLGANAILGVSIATARAAADFLGQPLYKYLGGFNGEQLPVPMMNIVNGGEHADNNVDIQEFMIMPVGAQSFKEALRMGAEIFHALKSVLADKGLNTAVGDEGGFAPDLGSNEEALSTIVSAIEKAGYKPGEEVRLAMDAASSEFYDKDNNNYNLKGEGVVKSASEMVDWYEELIEKYPIISIEDGLDENDWEGHKLLTERIGDRVQLVGDDLFVTNTEILERGINEGVGNSILIKVNQIGTLTETFNAIEMAKRAGYTAVVSHRSGETEDTTIADIAVATNAGQIKTGAPSRTDRVAKYNQLLRIEDELYETAVYAGLDSFYNLNK

SEQ ID NO: 43139 - protein, 1573 aa, Staphylococcus massiliensis S46
MTLTDDAGNTVSKTFNLTVKEFPKLKTPVVTDDLKSTTTEIHGTAEPGSLVTLINENGPILNSSGQPITAIVDQSGAFVIATPDGLPIDTEVQITSTKADHLDSDASTKDFVEDNEDLDQDGRPNYLDHDIDGDGINNEDEKLLNLNPKLADSDNDGTPDGDLDSDQDGILNKDESDPNSERATDRDNDGNPDVLTQLDTDNDGTPDINDPDDDNDGVNDVDEALMNLNPKVRDTNNDGTPDGDEDSDRDGLLNKDESDPTLNTATDRDQDGLPDIQTRKDTDGDGTPDVDDTDIDGDGINNADEALIGTDPKLKDSNQNGTPDGDEDFDGDGILNKDESNPNRADATDKNQDGQPDITTQLDTDGDGTPDHQDHDDDGDGINDADELLLGLNPKLVDSNNNGTPDGDEDSDGDTIPNKNESDPNSATFTDKDNDGNPDVLTQLDTDHDGTPDHQDNDDDNDGINDADEAHLGLDPKSTDSNNNVTADGDEDADGDGILNKDESDPTSNSITDKDGDNQPDISTQLDTDRDGQPDHLDPDDDNDGINDADERVLGLNPKSTDSNNDGTADGDTDSDGDGILNKDESDETSSDITDKNNDGKPDVSTQLDTDNDGTPDYLDNDDDNDGVSDADEAVLGLNPKLIDSNSNGVPNGDEDADGDTISNKDESDTTISTFTDKDQDGVADINTALDTDHDGQPDHEDNDDDNDGINDSDEALLGLNPKSADSDNNGTADGDEDSDGDTIPNKDESYENANAPTDKDGDGNPDVLTQLDTDSDGTPDHLDTDDDNDGVNDADEAVLGLNPKLADSDNNGKPVGDEDADGDTILNKDESDASSSQQTDKDGDGQPDINTALDTDHDGQPDHEDNDDDNDGLSDEDEQLLNLDPMNSDSDGDGVIDGDEDADADGTPNSKDDYPSDAKRHIDKQLDTDGDGIPNYIDSDDDNDGLSDEIERLLNLDPVNPDSDGDGVIDGDEDADADGTTNANDDYPNDAKRQIDKQLDTDGDGIPNHLDSDDDNDGLSDEIERLLNLDPVNPDSDGDGVIDGDEDADADGTTNANDDYPSDAKRQIDKQLDTDGDGIPNHIDSDDDNDGLSDEIERLLNLDPMNSDSDGDGLKDGDEDADGDGTSNSKDDYPNDVKRQIDKQLDTDGDGIPNHIDSDDDNDGLSDEVERLLNLDPLNPDSDRNGVIDGDEDTDQDGTPNSNDDYPNDATHLVDKQLDSDGDGIPNHIDSDDDNDGLSDEVERLLNLDPMNPDSDGDGVTDGDEDTDADGTPNVNDDYPQDATRQVNKQLDSDGDGIPNYFDSDDDNDGLSDEIERLLNLDPMNPDSNGDGIKDGDEDTDGDGTSNMKDDYPNDSTRQIDTQLDTDGDGIPNYIDSDDDNDGLSDEIERLLNLDPLNPDSDGDGVSDGDEDNDADGTPNSNDDYPNDATRQIDKQIDTDGDGIPNYLDSDDDNDGLPDEVERLLNLDPLNSDSDGDGIYDGNEDHNQNGISNKNEFSQAVPSHKLKHDRSEQKLDNQAGKSIKETQKDKASLKQLPATGSNHTSTTLLSVFSLFAGASLLLRKRRKRNKDK

SEQ ID NO: 43140 - protein, 2948 aa, Staphylococcus massiliensis S46
MKLKKEIFSIRKYKIGTTSVVLGALLFLAGVNEAEASTSTASNPSSTSPNPAASQPASNNQGSPTATASSPSSPTTTNASTPAATTNTSSTSNTAATASAPNSNTAATNYEGPRNPSEAGYLTNPQNGIITPGADNSFENGDFTNAVAHTKTVPQTQTGTSTSTNKGNVTHNWKELETNEFEGWRTEDSNRTFRVVEVGTATSDLVGHDQLTDSKLYEDPNHNPIRPVGNARNVLIGLAKVNHENRRYVELKTKGNAIYKEFEVVPSSLIYFKYHFAGVNSGGNGYVGSESLKAEILDANNLSNVIHSFERSGGYTGWTWDGTFIRIPDNVNRIRVRFEAGAKSTHFATAEAEGYLLDDVEIRLAPALKTDTNILHNGNSAYGENHIYNRGDRLDYQITHTNVGAVTLTKNKTVIKVSEELSFLTVNNSKLNPVFDRANHTLTFVNNERLEPGNSYTTNVTFVVNENVQGEVAIKSNSKLLPLHSGVIRPENHPELTTRIYDDNELGYEYGSDKMLYIDSKAPVINNVSDQSFEAGTQITPVSIDINDTDAHRTVTGSLSSSTHLPNGLIFDASTNTISGTPNQVGRFPVTVVATDVANNTTTSTFHITVGDTIAPEITPVQDQALIVGNAISPITVGYTDNDPQIPVINVSSLPDGVTYNAATKEISGTPTAPGVYEGLITVTDASGNAAEERFTITVHPPRGPLFTAIDDKQTNEDVAMTPIQVESDDAQATYVVEGLPNGVNFNATSKEISGTPDTPGTYAVTIRATGVNGLESEETFNLTVNDVTNPIITPIRNVKRELGNAINPINVVVTDNGPGPNRIEVNGLPDGVNFDANTNQITGTPTQTGDFNVTVVATDAGGNRVEAPFKITMTDRTAPSIRDIDNQVFELGNAMTPVTPIISDNSSGPFNIVVTGLPDGVTYDSNTLTISGATTTPNNYSISITVTDPSQNVANETFSLLVEDTTPPVIAPINNQDIEFGSAITPVNIQVTDNSTGPFTNTVDGLPQGVAFDNQTGVISGTPTEVGTFNVSVNSTDPEGNGATPVSFTLNVADTIAPTINEINDVTVPEDVAIQSIPIQVDDLSANVVVESLPQGLSYNSSAKVIEGTPENPGTYPIVVKATDPNGNETEERFTLNVTDTTPPTISPIPDVPNELGTAINPIVPVVQDNGAGPNVVSVEGLPQGVTYDATTNAINGTPRDVGEYDITLKATDPSGNESAPVTFKITVTDTIAPMITAIDDQNVNEDQDISPISVQVDDSTANIVVEGLPQGISYNPNTKVIEGSTPNPGTYPVVVKATDPSGNETEEPFNLIVADTTPATIDDIPDQNVELGSPMTSVVPVVTDNGPGPNVITVNDLPNGVTYDATSHTISGTPTETGAYQVTVHATDASGNAAEKTFTINVADTTAPSISEIPDQVNELGTPINVITPAFTDNGPGPNDVTVEGLPSGVEYDQSSNTISGSADDKDEYNITVKVTDPSGNESQESFVLSVRDTSAPNVTPIGNQHKEFGTPIDSVTPFVIDNDKGPNTITVEGLPPGVTYDRQTNTISGTATSVGEYDVTVRVTDPSQNEANLVTFKITIEDTIAPVIDEIGDQRVTEDQPITAIPVVVDDPTAQIVAESLPQGVTYNHTTKVIEGTPETPGDYPVIVRATDSQGNESTKPFVLTVVDTTPPSITEIPDQQKEFGSPIETITPVFTDNGKGPNAVTVEDLPPGVTYNNQTNEISGTPTSVGEFNVKVKVTDASGNISEEPFKITIADTTAPTITPIKHTTVNEDVAMQPIPVVTNDPTATVEIEGAPTGVSYNPLAKVIDGIPENPGVYPIKVKATDPSNNLTITQFLLKVNDTTPPVIDAIPDQEKELGTAIDSVVPVFQDNAKGPNVVTVEGLPPGVNYDSATNTISGTPRGVGVFEVNVTVTDRSGNASTPETFRITIVDTTAPVITAIDDLSVPEKAAITPISVHVDDDTANVEVLHLPRGLSYNAQTKVIEGTPLTFGTHNIVVRATDPNGNISEEPFTLTITDATPPTINTFDDQEIELGNPIFAFTPVIQDNDPNDKLTVNISGLPPGVERENQVFLKVSGTPTEVGEFTVQIDAADSKGNQAVPSTFKIVVKDTTPPTIDKISNQEKEFGTPIDSITPVYHDNASGSHTVSVEGLPDGVTYDANTNTISGTSTEVGTFNVSVKVTDPSGNESTPEVFTITVEDSITPTVTPIDDITAPEDQALTPISVVVDDPTASVVVEGLPEGVSYNPGNHVIEGTPVTPGTYPVVVKVSDPHNNRVEEPFVLTVTDTTPPLVTDIANQNIELGAPIAQITPNYSENSNGSNKVTVEGLPSGVTYDDKANTISGTPTSVGEFDVTVKVTDASGNVSIPETFKIIVVDTVAPNITLISNQRVPEDKAISPISVTIDDPSSKVEVEGLPTGVSYNVQTKVIEGTPDTPGTYPVTIKATDLNNNASESKFDLVVTDTTPPIIAEINDQVVELGAALKDVISTYTDNVQGTHKVSVEGLPEGVTYNSETNTISGTPKTVGSFTITVKVTDTSGNVSIPEVFTVTIKDTTPPQVNDIENQSVELGHPIKAITVNTVDNSTGPHTITVEGLPKGVTFDSKSNQITGTSTEVGTFNVTAKATDPSGNQSASKVFKLVVTDTTKPTIEAILNQSKELGTAIDTISPQVTDNGSGPNKIEVEGLPDGVTYDAKSNTISGTPKSVGNYAIKVKVTDPSGNSSIAEFKVNVENVKPPVVKDLTPPTIEDIKGQKVQLGEAINKVTPSVKDDSQVTISVEGLPSGVTFEKDQNAITGKPTQAGKYEVKVSATDEAGNKASKSFTIEVSDLDKPNKDKQGHKEQDKDPNIKVPQKDIKASQQGKGSKQGNGHVSTNTTTNVGSQSTANAHGSSQANKQREMSSGKASQAQRVLPKTGQNEQNISLFASASLLCLGTLLLRRKRKPHNK

SEQ ID NO: 43141 - protein, 236 aa, Staphylococcus massiliensis S46
MKKVLLTSTLALGLGVTGVAGNANAAEGNQTELANKAQNNPEALNNAPVQEGSYDISFSQNGLNYNFVSNGTYWAWSYGAGEQDASDLLEGEPVEETTEAPAEEVAPAQEEVAPVQEETTEQAPVQEEAPVQEAAPQTQAVQQPVQEQPAQEANNGGVQVNEHLQAIAYRESRNNPTAINPSSGAAGKYQFLQSTWDTVAPAEYVGVSPAQAPESVQDQAAMDLYNNYGAGHWVTA

SEQ ID NO: 43142 - protein, 169 aa, Staphylococcus massiliensis S46
MFGCGGCLGLLIILGILFGACTNSVVNEVDKSVNEEGTLDKDKDTKVKKVGETTEVDDIEFTLDGATYTDERNEFAEVEADKVLKVDMTIKNGSDEEIPVGSDVKVYADGKQVKTYPINDSLIDSLSPGRSISGSEGFAINGNPKKIELEFQPLMSFSNKRYVYEVNPQ

SEQ ID NO: 43143 - protein, 833 aa, Staphylococcus pettenkoferi VCU012
MIEARDNARDKKAEAQRKVDALPQAQKRDLPDQLARLTGIDVPDVNDANENGVDDKVDAQREEAEHAVEAAKNADQAAQDKLKEANADGLITPDEHKALEKAAQDAADAKQNAQDKVDVLPDDQKGDMPGELDKLNGIDVPDVNDSDTNGVSDDIDEQREEAQAAVDVAKNADQAAQDKLKEANADGLITPDEHDALEKANQDAADAKKNAQEKVDALPSDQRGDMPAELDKLDGINVPDVNDSDANGVSDDVDKQREEAQAAVDAAKNADQAAQDKLKEANADGLITPDEHEALEKANQDAADAKQNAKTKVDGLPSDQRGDMPSELDKLHGIDIPDVNDSDANGVSDDVDAQREEAQAAVNAAKSADQAAQNKLKEANADGLITPDEHDALVKANQEAAEAKQNAQEKVDGLPSEQRGDMPSELDKLHGIDIPDVNDSDSNGVSDDVDQQREEAQAAVDAAKNADQAAQDKLKEANADGLITPDEHDALEKANQEAAEAKQNAQNKVDALPSDQRGDMPSELNQLHGIDIPDVNDSDANGVADSIDEQRNEAQQAIDAAKRADQIAQDKLKEAQADGIITPDEHDELEKANQDAANAKQVAQDKVNTLPDTQKAILQPELDALHGIEVPRVSEQEPEEPEPNNPDQPSQPQPSQDHSDDVHHSTHQDQPATHTNDQPAGNTTSHTRPTVDQAQHAVDQAQQEDHNAKEKLQQAMADQVITTDEQHDLAQAQQSVIAAKQEAQAQIDQQPAQEQSTLQAELDTVTNIEIPSTGAHPVGTTPQSPSHTTSQDEDALPDTGEQATSQGTILGSMAALIGSLFLFRKRRKHKDEQ

SEQ ID NO: 43144 - protein, 872 aa, Staphylococcus pettenkoferi VCU012
MKDKRRFDFIPNRLNKYSIRKFSVGIASILVGATLFFGLNNEAKADEVNVTSEHGNNNGENASSTSEDETDQAQTQETAQSDASTPEASQETQDQTTSRDDNAGSTASTEQTQSADSQATSDKSDLESEDAQNEASNSSAENKASEGQQENSAQSEDQDNNADHEDAAQQDKDDSASETSQQDEDGDNAATDVDDKSQADKGSTEGDKDKAHDDKTSSNDAEDQAQDNESSTSKDEHAESDNKDTDASKNYKTAKSDKTTEHAKDQVTSDEQDKDTASSNHSTETDKSVRKDVLNQKSDKASNSSKTVSDAREEEAKVSAASDELDTLAEEAETPEELYEKIKDLSSDMDKSKALATLQSRASSSPIFRQAYAATASNEKYNGKIIDFDDPLVKKVDQPNTALAPSDINFSPRFKEGKSKSYAFVIDKDGKVSKKQLATKNNDDIRAYKGNYIRLNNDNPEAYVYFSDIGVANGKTVDALAHVTMNPSENGDRNNTRYFMTSGTDVLSLLSDSGGGAHVDLSFYQHADQSKYDDYYNQADTKTLTKNQLFDDLASMNHKKTKVSGLFNVYDLDDYDKNKAKDVRKSITFNRNEINNLYISNEKGKEATSLLELDGDDVTITSGPGAASGTYENNKRVTVSYLDKSDISYTMTGRGSSGPAFDVKGLLLKQIPPYNTDQRASASKGDAQLDITQEIPARDVDKKATLPGNLSIGVEVPEGIRLALEENSDGLFTSDSSQSSTNKLSIVPGMNGKKDLSLLEKQKYYDTIQNLTLTLTHGLTLSDVENNTDKWTKLKDYYDKDSETLKVPVKWSFNNGDKSWDNLETDVAHANLKLPDDVKALINQINDAEEAVEAAKRADQDAKDQLQDANSD

SEQ ID NO: 43145 - protein, 324 aa, Staphylococcus pettenkoferi VCU012
MKSLFKNLHLFSIRKLTIGTASVMLGSLFILGGSHNAHAAENESTINDESNLEVQQKETIENESNNENPIKTTSQNKTLETNSQETNYENQPQENISSTDKAEEPTTQNNLINEKQNQNETQLQLDEDYQSYKSQDKNQLTQEEISSHKPVNNDKNLPSDIEQQPNTSISGNQDENREYAANNTSIDNKQNMNSSVITQEAGKKKYGSAKWLTKHKISYGFGRYNLPNNGGQHYGVDFVMPVGTPVKAVTGGKVLNASWDPMGGGNTLTIQEPDGKHTQFYMHLNKFNVSKGQNIKTGQVIAHSGNTGNTTGPHLHFQRMNGHT

SEQ ID NO: 43146 - protein, 451 aa, Staphylococcus pettenkoferi VCU012
MKSFLEKSNRFSIRKITLGAASVIVGSVMLLGVGNNAHASEQDSTESQQEVTHNNTESTPTSEESEEASTSNSSQNASSNEIEAQQNNQATNEDMNDAQNNKVEQDNFDNDDKTQDKQGTHNDLDNQQANTSSENEDKSVNDDKNETNKSSNQSDEQQDVRTSSETSINDIDNKHNSVDQHDKDNTEKDNVNKNEVNQDNRHQDSQDTQQDSQSEKNHNYSSDDNDNNEENNTDEVNDKTKSNKLDNQDNKKETQASDDKEIDKAFNDRFRSSDSSKDEKEKTQDETNSANLRETNKVESEKDGKEEDNNTTNNKDFLSSNKDNLKDDKEAVNKYIEDQDLDNDTAKYIKDNWKDLSNKELYQLLIQDFENKQNKEKKLATNREASKRKQTAFDEDSNESAFRSAKNTTKNYKVKNGDTLSGIATKFKTTTAKLQKMNKIKNANAIQVGQT

SEQ ID NO: 43147 - protein, 335 aa, Staphylococcus pettenkoferi VCU012
MPEQSNYKERHPQRSNSKARPKPAHKPKKWPMVVTISAVIILLLAAGIIALILFLKSGTPYSSRADKAYKVGQTAKNGDLEVTLKSASKSKQVGPSITPTTAKGTYIVVDVKIKNKGKEALTVDSTMFELLSEGKTLKADGTASVMANTDDNGENSNSFFLEQVNPDSTAEGQIVFDVSSKVAKSKDKKLKISSNLFSTQYVTFKLPKLTSSDDEATDDEESDTEEEADSANDAATQGTGHVAQPRNSGNTSQGTVRRSHSDDSTASKSQDKDDSDTKAQNSKNQSSPSQSTPKSNQQSPNQQGNANQTPKQSAPSNNNSNGANSGNSNQSGDNK

SEQ ID NO: 43148 - protein, 231 aa, Staphylococcus pettenkoferi VCU012
MKKTLIASTVAVGLGVTGVAGGHHSADAAEQGVNKAELAQLAQNNPQQLNESPVQEGSYNYDFDYNGAHYHFESNGSTWSWSWNGYGEAAQQDNTQEAATTSNVNTQQVSTQQQPKQQQAPQTAQTQQPKQESTTQAQPKQQSTSSKGSSAGTPAGMEGIVQRESGGDPTAVNPSSGAAGKYQFLQSTWDSVAPSQYQGVSPAKVPEHVQDQVANKLWNGGSGASHWAPTV

SEQ ID NO: 43149 - protein, 353 aa, Staphylococcus pettenkoferi VCU012
MRKNSPQFMNKKHNYSIRKFTFGTASIVVGATLFFGAGQAHAAEQGQQSDDTTTTTAQSSQDNGNQDSEDVVNDNDQANQTKQNTSDQASQESPGTSETETQNTQNSNSSNAQGEDTNDNQETNTQPHNKMQNEDNNQTSDNEQDTNASTTSNDQSTSNQSSDQDNTDNGKAEQEQPQQADDNQNSESRSSDSEQTTDNKADDTSDSANLNAKNNNAQNANSDSSQPQSANDTTSTNSNMKQSTSKNDENNSNSAQNTTDSSAQQAPQSSQEQSPKHNKETKDTSASSSQDTTQPTQNTNSQQSTNDDGDNNQASDHNKDTFFSVPQTNDDTNSQQNATNIHNQSDLVDHYKD

SEQ ID NO: 43150 - protein, 1562 aa, Staphylococcus pettenkoferi VCU012
MGTASIIIGATLLFGAGQDAKAAEEDGYSQEVGKDTSDSSDDQADVQTKQTETSNNDTQADENSSSNAEEITTDSSEQEQSSQNGTEHETEATTEHTSEENSSDTANNEEKTKVEDHQSEPETKTNEQTQSEEKDADVETPQSGKEQIEPTTKKSTVREENETTSDEKVQKENVAEEDVVSGKQEQSEGSTTTAPTESKRSVIINKDNLDENQKAELDAFDAEYKAAEDKSEVLTNVLKDNNFNDEQSAEILSNIKDGDLDNLSSDEVLEKLIYEAIQYSQKHKLPETYATVPTSTTNSISETAGNGGTSFRAVEETGRNVNDKVNFTNLKTDIKTKAGGTRNEFWVTSGDYLLISGDYTVDNDVHSGDYFTFDWGNYFRQGGIHTPPKPHFLYSDDGRIVARGTYDTSTNTTKYVFTDYVDSGLQNIHGHYETTGFTNKDSHTNDKQAYPTNFRLGGESFSSNIVVDYGHPKTAILTTGTNYVDSRDNTYHMTNYINQSGERKAGYGLKISLKNMKFDNASNIKLYRVTNNSSFTDNYNPDVSNLQLVNTTPTISADGTVARFDYPAFNMAGGQKYIVQYTAKPTNDDPSSRELRTDLYELGNESNSYNHTVYISTFGSVSSASGENKPTPKLTYELGDYVWEDSNKDGIQNSNERGIQGVTVVLKNSNGQEIKRTTTDSNGKYLFTGLENGSYTVEFGTPDGYEPTVVDAGNNDEVDSDGSTVNVTINGGSNYTIDSGFHKKEVEPPKEEAKYEIGDYVWEDSNKDGVQNSNEHGIQGVTVILKDNNGQEIKRTTTDSEGKYLFSELSNGTYTVEFETPNGYVPTKTNVGDDHLDSDGQSVRVTVNNANDYTIDSGFHKPDEQEPPKVEAKYEIGDYVWEDSNKDGIQNSNERGIQGVTVILKNSNGQEIKRTTTDSEGKYLFSELSNGKYTVEFETPEGYEPTKANVGDDRLDSDGQTVDVTVNNANDYTIDSGFHKPDEQEPPKEEAKYEIGDYVWEDSNKDGIQNSNERGIQGVTVILKGEDGNEIKRTTTDTDGKYLFTDLSNGKYTVEFETPEGYEPTKANAGSDDRLDSDGQRVEVTVNNANDYTIDSGFHKPEETPEKPESTYEIGDYVWEDSNEDGIQNKNEKGIEGVTVILKDKDGKEINRTTTDKDGGYKFTGLHNGDYTVEFETPEGYEPTKPNEGDNPELDSNGTSVHVTVNNHNDYSIDSGFHKKVETPEKPESTYELGDYVWEDTNKDGIQNKEEKGIEGVTVILKDENGAEISRTTTDQDGKYKFTGLKNGKYTVEFVAPEGYVPTKENVGNDSIDSDGSSVEVTINNANDYTIDSGFYKEIDDTDADADSDADSDADADADADADSDADADADADSDADSDADADADADADADADADADADSDADADSDADSDADSDSDADADADADSDADADADSDADADADADADADSDSDADSDSDADSDADSDSDSDADADADADADADSDSDADHGTEHDPNSDADHDGHTQDGDHDGNTKDHGSDKGHDKALPDTGSDNANTTLLGTVLAGLGSLLFFRRRKDSKEEK

SEQ ID NO: 43151 - protein, 813 aa, Staphylococcus pettenkoferi VCU012
MKQRRNKYSIRKFSVGASSILIASLLFLGGGSAHAAEKAEQQADSTTGSTTQTTGEQAVQDSESTPNTSQTSQQDTPQDSDATDHNDSLHKDTPQTDDANISSQDTPDNASTEQPTDNDASNNATQSDASPSTDDATHSKNHADQMPSQGQANDDADTKADNDETQAQSDNNDVAQDDQADTSQSHQDSAQQADQADKDTTAKDDDTQTAKHDQDADQQDKQDSHKVDNDKDQQDKQDADQSDDDADAQQADAAKHDADATDHTSDKQSSKDEDPATSSNQDVTAQHDDAQTDDANHSADDHTATDDAKDQDSDAKDDSDAQDTHATEPSNQSAQTTQDNADDTNDAAQATSKMTAHQDTDDVDKKKEIDPDFSAVDSETLDQQDQSEDEKKDKDDKEGLKTLKDNAVATQSNNKTKSRDAEEVKDQPDKKADQQHYKNKEPIVLVHGLSGYTDDIKPDVLEHYWGGDKADITQDLEQHGYKTYEASVSAFGSNYDRAVELYYYLKGGTVDYGAAHAEKYGHERYGKTYEGVYKDWEPGKKVHLVGHSMGGQTIRQLEELLRNGNKEEQDYQKEHGGDISPLYQGDHDNMISSITTLATPHNGSHGSDKLGNEALIRQVVYDYAKWTGGKDTKQDLGLGQWGLKQRDGESFNDYLKRVKQNDKLWKSKDNAFYDLSLAGASKINQNTSMNPNISYKTYTGSASHRSLGGRYKSDLNMMFLLSITGNVIGKVNEKEWRDNDGLVSVISGLHPFNQPHVDASDKDKKGVWQVTPVMKGWDHADFVGQDYSDTKRSAQELKEFYRGIADDLVSIEE

SEQ ID NO: 43152 - protein, 1795 aa, Staphylococcus pettenkoferi VCU012
MRNKKRKGRLDFLPNRQNKYSIRRFTVGTASILIGATLIFGANSDAKAAEDTEANSSHSVGNNDKGEGSVKESTEAEAVSNPETTDTTSHDTQATETEASQASDETSSTEQSVQDDQTQEEATDVQSEQPSQHETKASNDDTSSSQVDPSTQQKEDQSTEETSNETDQVQTEETTQSVESNKEITQSSNNKVETQDTHADINKVEDRTSAVDYYAKTTGVSNEEAEQAIDDLNIDTTKASVKEIKQAVLFEALKKYSDEQNQNPVAVRGYAGFREADGAPDVRTSKTIKGLDGAYTQLGSPAYNDYYVGGGERVNTYEMANRRGAKSGFLLKDKVSFAKDFTFSYDIANNEQRTSTNGDGWGFMFAGDNINKFTQYGGITSVKGLPNAVGFKIDTHFNPGERGYVQPEHEMEGYASFVKNDDEGTSHNVGPHSTLKYADRVHRQIGVGQNIDGANLNKITLSYKASTGVLTANYLNQSWSINVSELGLDKNKEYNYAVTSTNDSNVVGNTHYNIAIDSALSQYGVATPARDYHPGYDKVEVNLGGTVKSPQIHDKDLPPGTKFVIYPNEVPTGWTATVNENTGEVTATPPANAKRSEDVHIPVHIIYPKNYSGALRAAPDDVVVDAPIHLNVTDAETYSPAYHDETTFPAVTVKLPQIGDSTVPSGSRYELAGDFPVMPGWTVIVDANSGEISVTPPEDALPGTDQEIRVRVTYPDGSSEKIPAKVSVVASDAYRYNPGYDHKVIRPGETIQDPQTQERNIPANTRFGIDSSFSNDAIWTVSINETTGELTVKTSENAKPGEEIDVPVRVYYPDGTVDKAKANIRIVADDAYNNSPGYDEGEVRPGGTIGLPQNKDTDMPANTHYSLDKSFNESGWTVEVNRNTGEITATSPEDALPGNVVNVPVLVEYPDGSREIASAKITVIEDQASQYDPYYDDATTRPGVPVDVPQLGETDLPEGTTYRITNTDEIPNDWTVSIDATTGVITATPPITAHRGQGITVPVTVVYPDGSTTDTDASIDVISSNADDHNPSYEPKTTTPGKAVEVPQTGDKSIPRGTKFEGPKDVPTGWTVDVDPNTGKVTATPPADADPNTSVDIPVTVKYPDGSTETTNAKVTVTPNDAQENDPGYEDKSTKPGQPVDVPQTKDKDLPPGTQFEGPKNVPDGWTVNVDPNTGTVTVTPPKDAKPGTKVGIPVTVKYPDGSTDTTNANVTVLTPDAQEHDPGYDPKTTKPGQPVEVPQTKDSDLPPGTQFEGPKDVPDGWTVDVDPNTGTVTVTPPNNAKPGTEVGIPVTVKYPDGSTDTTNAKVTVIPKDPSETDAGQNDPGYEDKTTKPGQPVEVPQTKDSDLPPGTQFEGPKDVPPGWTVDVDPNTGTVTVTPPADANPGTEINIPVTVKYPDGSTDDANAKVTVIPKDPSETDAGQNNPGYNDAHTQPGQPVTVPQTGDTDLPPDTTFEGPKDVPEGWTITVNPNTGEVTVTPPEDVQPGTEIEIPVTVHYPDGSTDEVNAKVIIDEPEESDADADSDADSDSDADSDSDADSDSDADSDSDSDSDSDSDSDSVSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADADTDHHDPGYDDAKTQPGKPVEVPQTKDKDVPEGTRFEGPKDVPTGWVIDVDPNTGKVTVTPPADATPGTEVNIPVTVHYPDGSTDTPNAKVTVTPKDPSETDAGHH

SEQ ID NO: 43153 - protein, 457 aa, Staphylococcus pettenkoferi VCU012
MKRNQSSRHRFGIRKLTVGVGSLIVGACLWIHIGDSDVAEAAEVDNAEQVQQTADTQGEQQAEEPQDEIQNNEAADTTGSQQEEAMKTQAEPRQIETDSGEGKQDLSETSASDEQNVEAEAETKANTNNASSENEIYTYQQDKEPQGTEDSAQSTQENEEVTPTEEEKSDEDINVEGSDQAATQATQQHQDEVTENEINTQESTSETTFFAMPSYGSAEWLNAYNVSYGFGSYPLPNNNGMHYGVDLPMPQGTPVRAITGGTVQYAGWDQMGGGNTITVQEPDGQHSQFYMHLSGFNVAAGQTIQTGQIIGYSGNTGASTGPHLHFQRMNGYPSNETAENPLPFLQSLGYGNGGQSGGSSSASHPGFQENQYGTLYKEEHASFTPNTSIITRKTGPFINMPRGGTLEAGQTIHYDEVMKQDGYVWLGYDSNGGRRYLPIRTWDRTTEQIGSMWGTIS

SEQ ID NO: 43154 - protein, 1820 aa, Staphylococcus pettenkoferi VCU012
MGSEDKIVEGTAEPNSIVTVHFPNGTSVESHAGKDGRYNAEIPSDLKLKGGEKITATAKDIDGNVSEEGSTTVEDNTAPDVPTVVGVNSTDKEVTGTAEPGSEVTVHFPDNKTGTATADDNGNYTVKIPDDVTLKGGENIDVTAKDKNDNVSEPAHTVVSDKTAPDAPEVEKVNSNGDKVTGTAEPGSTVKVTFPNGKESEGKADDQGNFSVDIPKEANLKGGEQLNVVAVDDNDNTSAPTSVTVGDKTAPDAPTVDDVKSTDKTVTGEAEPGSTVKVSFPGNKTGTATADDNGKYTVEIPEDVELTGGEDLTVTATDKDDNESEATHATVEDKTAPKKPEVNKVTSNSDKVTGTAEPNSEVTVTFPDGQQTKATADKDGNFTAGLPKGVALKGDEELQVTAKDANGNTSETTEVTVKDETAPDVPQVNDVTTDSKTVTGSAEPNSTVTVHFPGDKTGTATADKDGNYTVDIPEDVELNGDDEISVTAADKDGNTSDAKTVTVTDTTAPDKPSVDDVTSDSKHITGQAEPKSTVTVTFPDGTTATGETDDNGRYTVDIPEKIDLKGEEELNVTATDKAGNTSQAETKTVTDTTAPEIPKVDGVTSADKHITATAEPNSHVKVTFPDGTTATGETDKDGNFTVDIPSKVDLKGGEELTVTATDAHDNESTPAKLPVADKTAPNKPSVEGVNSTDKEVTGKAEPGSEVTVKFPGNKTGTATADDDGNYTVKIPDNVDLQGGEELEVTATDKAGNTSDATTTTVADKTAPDAPSAEDVNSEDDAIKGKAEPGSEVTVNIPGHDPITGTADDEGNYNIDLPKDLEGGEEITVTAKDKDGNVSGETKKTVTDATAPNKPSVKGVNSTDKEVTGKAEPGSTVTVKFPDGTTSTGTADNNGNYTVEIPDNVDLQGGEELEVTATDKAGNTSDKATTTVADKTAPDAPTTNDVNSEDDTIKGKAEPGSEVTVNIPGHDPITGTADDEGNYSIDLPKDLQGGEEITVTAKDKDGNVSGETKKTVTDATAPNKPSVKGVNSTDKEVTGTAEPGSEVTVHFPGNKTGTATADEDGNYTVEIPDNVDLQGGEELEVTATDKAGNTSDKATTTVADKTAPDAPTANDVNSEDDAIKGKAEPGSEVTVNIPGHDPITGTADDEGNYNIDLPKDLQGGEEITVTAKDKDGNVSGETKKTVTDATAPNKPSVKGVNSTDKEVTGTAEPGSTVTVKFPDGTTSTGTADDDGNYTVKIPDDVDLQGGEELEVTATDKAGNTSDKATTTVSDKTAPDAPTADEITSESPSVKGKAEPGSTITVNIPGHDPITGTADDNGNYEIDLPRDLQGGEEVTITATDKDGNVSGETKQTVKDTTAPDTPTINDVTSSDNSVSGTAEPGSTVTVTLPDGTKVTGTADDNGNYTIELPQTLNGGEELEVTATDKAGNTSDAATTTVTDTTAPTEPTVNGVNSTDKAITGNAEPGSTVTVTFPDGTTATGTADDDGNYTIEIPDNVKLNGGETVSVTATDKDGNTSNPTSVTVADTTAPTTPTINDIHHGNTQISGHAEPGSTVTVTFPDGTTATGTADDQGNYIIDVPSNMNLKPGDTVTVTATDKDGNTSDSAEVTVQEGNNVDPGNSGSGDQPVDPDNNGSGDQPADPSMNNGGNNNNSDNNGNHSASNNTGQPAHHNNTGSNSTNANQPTAPAVNPIGQHDHGISGQNATPGNTIVATFPDGSTATTTVNNDGTWNITVPANTHFNNGDTVQVVEQDASGHTSNTTSVVVGDNHVAQGNDQDTADLPDTGNSESNKGTIFGTLFAALGAIFLFGRRRKDKKDEE

SEQ ID NO: 43155 - protein, 1204 aa, Staphylococcus pettenkoferi VCU012
MRKRKPQGKLDFIPNRNNKYSIRRFTVGTASILIGATLVFGINNDAKAAETNDAQSSVNANDSQSSNDDPNNSTTSHDTSSQETAHDPQVNNDTNQDNQAPQESNTEETAQSSQDSNETSQPSSSQSQASDNQSNPSDNDVDQPASNADDVHKSDAAQATTDEDGADNSDSDDETSNDDSQVNETEKQNQPDDNSAKDDVDKQGASDDNAAESDNEQSSDDAKDKSDNEAKDDPQSSTDNKSEKDSQKEEHSKKGSNKEESDSESDSEAQSTKSKSDEDQPEEKQDDDKSGDNQADEKSDDKSSDKETGSDEDDSDSVEQGKDKSDNETQETKDTKASDSEKKKDKLQSKLDDADSNDKEDTVNDYLKDQLGGKQAKSVLEDADIDYDKDSNATISDKVLKSALIQFANQKDKDSPQAIRPGSAFFSAYSTEAVTRAAKDTKVAKSLGYENNYTFSQIMFDPDSLDSDEAKKSTTIPFKIHSYLTGDNSLDRYKIDLDLDSRLAKHVTKISARPVGGDKPVEFKRLKDENGEPSDIWEVNFIRAQGGLFGGAEILAIYTAEDGKIELDDSIENIIKEENLDKDKLNYRVYVRNNETNKIIRTAENSGYFLTDVDKELTDKEKDISTANKGSFLGSSGAVQYDQNIGEHGGLTVDQTIMKNSIFDYILYAGNKQWTYNYQIDKDLLPYISGAELHLHDYKGLAGFDKEYHERDKVADLSFDKDGKGSITDRNMNRLIEFNNSNPEPIGIRIVLKFNQNPNNILTKDAEYDDDGNLIRETVKQKELFNFNGYLTDNKGKLINNTLGTSTLAIQDYDRDGLLDNYERQNTHSDPFNPDTDGDGKNDGDEVVNYKTSPLVGQPKASDITTEDTVVSGSVPLKDGAATQTAKVINSDGETVGTGTVNSDGSFSVNIPKSPEGTYTIAIDSPDYENDETNTFKIVDTSKVPAPTINPVSDKDNEVIVNGTGGSTVTVRDKDGNTVGTVDIPDGQSSGTIHLDNPLKAGTELTSTASKNGKESDPSDTVTVDDKTAPNQPTIDEVTTNNTSISGKAEAGSTVHVKLPNGDTVSAKANDEGAYSVDLPQDLELNGGDNITVTSEDDAGNISESNSTKVINKRAPEAPTIKPVSSEDHSLTGTAKANTTVTVEFPDGSTLDTKADDQGNYTIDLGDKKLDGRETLKVTATEDGNTSPATTTVVKTIQHLMHLQ

SEQ ID NO: 43156 - protein, 221 aa, Staphylococcus pettenkoferi VCU012
MKKLGITSGIVLSGAVLFGGIGTSQAHAESYSSVDASNAENIAKEVAKDNGMDPSKQNFFEPKSSGDYYQVEIGNKSNVGAGAYRVHKDGLVEYRDGGVESNPYHKVGNYHFSDADANTTNDSKNDTNQQQDSTNTQQKQNVTQQNQANPSNASQQQNAMQFNQNNEQQAQAQNVKQTDQSEAQQAQALPNTGQSSNSLALGVLAAVLGVSVLAMRRFIRQ

SEQ ID NO: 43157 - protein, 844 aa, Staphylococcus pettenkoferi VCU012
MDEGAQLPDGNTEGTVNVPVTVTYPDGTTAHVNVPVTTKAAEDNTKMPQVDDVTAGDKTVSGHDGQPGNTVVVTFPGDKTGTATVDDNGKWTVNVPSDVTLKPGDKVTAVEKDNHDHTSPVTEVTVNDTENTAHQPQVDPINGGGTSVGGKGTPGNDVEVTLPGGTKVPGTVDENGNFTVKVPDGTELKPGDKVTVVEKDHNGHTSPATEVTVGDYPNTAHQPTVDPVTAGDKTVHGKGTPGNTVEVTLPGGTVVTGEVDENGNFTVKVPDGTTLKPGDEITVVEKDNHGHASTPTKVTVGDTANEAHQPQVDPIHGGDKTVHGKGTPGNTVEVTLPDGSTVTGEVDKDGNFTIDLPDGKELKPGDKVTVVEKDKDGHSSTPTEVTVGDYPNTAHQPTVDPVTAGDKTIHGKGTPGNTVEVTLPDGSVVTGTVDKDGNFTVKVPDGTTLKPGQVITVVEKDKHGHASTPTKVTVGDTANEAHQPQVDPIHGGDSSIGGKGTPGNTVEVTLPDGSTVTGEVDKDGNFTIDLPDGKELKPGDKVTVVEKDKDGHTSPATEVTVGDYPNTAHQPTVDPIHSGDKTVTGKGTPGNTVEVTLPDGSKVTGTVDKDGNFTIKVPDGTTLKPGDTITVVEKDKYGHASTPTKVTVQDHANEAHQPTVNPVHTGDKTVTGKGTPGNTIELTTPCGKTLTTKVDKDGNWSIDLPEDVHLKAGDKVTVVEKDQYGHTSTPTVVTVTDKEMNGNNCDMPKKDDNGQAPMDNHGSDMNTGDMTEHASTPAMTQGSDMAQGHDDSMKHAEVKDDAKSEAKALPETGNTDNSGTIFGSLFAALGALFLAGRRRKKEDK

SEQ ID NO: 43158 - protein, 875 aa, Staphylococcus pettenkoferi VCU012
MKSKKSKSKLDFLPNRNNRYSIRRFTVGTASILIGATLLFGASHDAQAAEEDSSSVSVDGQDEAGASKDDQTAKASEEQATPAQTEDVKASTEAEASTDTETQAQADKEEAASTQEDAVSEDSQSKAQDSEQAEEATPAKEEAAQSEDAQTTEHASVKEAKSEDKKVDTESATTSEVPQATEEEVATKEESKAVQPATVADKKAASVDPSPYANIGNVHDKASAEEFYAKATGVSAKEAKRVVNNLGLDAKNITPESFRAALLKAFSNAQNRTAVQGLSFRAAPEDSEAINDMANAVNATAPTADDDNMKIIDADAYKNGYVKNDVDTTNAANTLSGRAYMSDFGAPGTTSTRLTTVPEGTAVYMQWIDKDGWVSPAFRAYTTNQITDRDSSAAGPGFYAFDLRKPQIDANGKSHVYNATDGQYYRLWIEDFQTANGNTATMLRQVGGLIPGTFVNSVTHLNLGQFPLIGKNMQRTGVFMGVRPTNDYMTRPKEEWIHDEEGPMANPYTDLKAKNTISGRVWLETGDGDEANSGTGPNRNPGDPVAQGYTVVMSSLTKEGAAAYKDQVQSLDHGQRAEAAKQLLEDHPEYISATVYGETDEDGHYTLRFPKDTLDVNFLYGYVMDKDGVVQNAYSSYTAPEFRTPNTNALFTPQAIPGHNLIVDPMWYNVHFAVIPRTDVEISIVDFNNTDKPAAPGDVAHIDLEGKILSPLPTHVEWRDNNGKVVKKTPDFTSLKEGEDAGTFEIPSTAKDGDHYTAVLVVNGRDVSADSLTVKVTDAHTYEPKVTPITKDYGTPTTEDDVKKAVTVPDYPADKGTPKVTIDEGAELPDGNTPGETNVPVTVTYPDGSKDHVNVPVTVKEQPQADHYPPESNTS

SEQ ID NO: 43159 - protein, 197 aa, Staphylococcus pettenkoferi VCU012
PKDVPSGWTVEVDPNTGKVTVTPPTNATPGTEVNIPVTVHYPDGSTETTNVKVTVDQPERPSTHNEGKQPTQPKPTMDNNCPTGDVEHPSTEGEKAPTSPSAQTEGHTEVPAQTPSTTHNTMNNGAETAGQEQHATQDTMSSDDKVQPTHATTHSDAKALPETGETDAARTTAFGSLFAGLGALLLFRRRKNSKDEQ

SEQ ID NO: 43160 - protein, 434 aa, Staphylococcus pettenkoferi VCU012
MPIITDVYAREVLDSRGNPTVEVEVLTESGAFGRALVPSGASTGEHEAVELRDGDKNRYSGKGVQKAVENVNEVIAPEIIEGEFSVIDQVSIDKMMIQLDGTDNKGKLGANAILGVSIAVARAAAEYTDQPLYKYLGGFNGKQLPVPMMNIVNGGSHSDAPVAFQEFMILPVGAESFKESLRWGAEIFHQLKAILKDRGLETAVGDEGGFAPKFKGTEDAVETIMEAIKAVNLEPGKDVYLGFDCASSEFYENGVYDYTKFEGENGAKRSAEEQVDYLEELVNKYPIISIEDGMDENDWDGWKVLTDRIGDRVQLVGDDLFVTNTVKLAEGIEKGIGNSILIKVNQIGTLTETFDAIEMAQKAGYTAVVSHRSGETEDTTIADIAVATNAGQIKTGSLSRTDRIAKYNQLLRIEDELYETAKFDGIKSFYNLEK

SEQ ID NO: 43161 - protein, 291 aa, Staphylococcus pettenkoferi VCU012
MTGVRRWLSKHRMWNLPTLIALVLFLIFVIFLFMVMNHNDENSSTIYVTQDAELRTGPNAAYPELYPVHKGDNFHKIGKSGKWIQVESHNKKEKGWIAGWHTNLDIKKDVTASKDSLKGKTIVLDPGHGGSDQGASSRTQKKSLEKVYTLKTAKELKALLTREGAHVKMTREDDSYVSLSDRNLKGDAYISIHNDSLDSTKANGGTVYWYRESQESLAETLNQSIQKKALLSNRGAKQENFQVLRQTNQPAVLLELGYISNPTDEDMITDKLHRHVVEEAVVDGLKIYFSN

SEQ ID NO: 43162 - protein, 171 aa, Staphylococcus phage 3A
MVKKRLLAATLSLGIITPIATSFHESKADNNIENIGDGAEVVKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNKIKSR

SEQ ID NO: 43163 - protein, 489 aa, Staphylococcus phage 676Z
MLNPTLMCDFYKLSHREQYPEGTEIVYSTLVPRSNKYYEHSDNIVVFGIQSLVKKYFIDMFNKEFFNRPKEEVINEYKRTVKFTLGQENPDAKHLEQLHDLGYLPIDVRALKEGTVVHPNTPVMTIENTHSDFFWLTNYLETIISTQTWQAMTSATLAYDMRKMLDKYAMETVGNIEAVDFQGHDFSMRGMSSLETAQLSSAGHAISFKGSDTVPVVDFLESYYNADVEKEMVVASIPATEHSVMCANGNYETMDEYETYKRMLTEIYPTGIFSIVSDTWDFWGNMTKTLPRLKDIIMERNGKVVIRPDSGDPVKIICGDPDADTEYERKGAVEVLWDTFGGTETEKGYKVLDEHVGLIYGDSINYERAQQICEGLKEKGFASINVVLGVGSFSYQFNTRDTHGFAIKATYAKIKNEEKLIYKNPKTDSGKRSHKGRVAVYKDGSWEDNLNLHQWLNKQNLNQLERVFEDGKLYRDQSLSEIREIIKNN

SEQ ID NO: 43164 - protein, 381 aa, Staphylococcus phage A3R
MIKRRKHLDHSLQPEKGWRTVPFNGYYEAHPTGLIRNKVTKKLIKGTQTRKNHPKWTAHEIVYLINPKKTSYSRGVVIAHTFPEMISQSRGDLKNGHVCFKGSDTVPVVDFLESYYNADVEKEMVVASIPATEHSVMCANGNYETMDEYETYKRMLTEIYPTGIFSIVSDTWDFWGNMTKTLPRLKDIIMERNGKVVIRPDSGDPVKIICGDPDADTEYERKGAVEVLWDTFGGTETEKGYKVLDEHVGLIYGDSINYERAQQICEGLKEKGFASINVVLGVGSFSYQFNTRDTHGFAIKATYAKIKNEEKLIYKNPKTDSGKRSHKGRVAVYKDGSWEDNLNLHQWLNKQNLNQLERVFEDGKLYRDQSLSEIREIIKNN

SEQ ID NO: 43165 - protein, 489 aa, Staphylococcus phage A5W; identical to SEQ ID NO: 43163

SEQ ID NO: 43166 - protein, 489 aa, Staphylococcus phage Fi200W; identical to SEQ ID NO: 43163

SEQ ID NO: 43167 - protein, 454 aa, Staphylococcus phage G1
MLNPTLMCDFYKLSHREQYPEGTEIVYSTLVPRSNKYYEHSDNIVVFGIQSLVKKYFIDMFNKEFFNRPKEEVINEYKRTVKFTLGQENPDAKHLEQLHDLGYLPIDVRALKEGTVVHPNTPVMTIENTHSDFFWLTNYLETIISTQTWQAMTSATLAYDMRKMLDKYAMETVGNIEAVDFQGHDFSMRGMSSLETAQLSSAGHAISFKGSDTVPVVDFLESYYNADVEKEMVVASIPATEHSVMCANGNYETMDEYETYKRMLTEIYPTGIFSIVSDTWDFWGNMTKTLPRLKDIIMERNGKVVIRPDSGDPVKIICGDPDADTEYERKGAVEVLWDTFGGTETEKGYKVLDEHVGLIYGDSINYERAQQICEGLKEKGFASINVVLGVGSFSYQFNTRDTHGFAIKATYAKIKNEEKLIYKNPKTDSGKRSHKGRVAVYKDGSWEDNLTLHQ

SEQ ID NO: 43168 - protein, 489 aa, Staphylococcus phage GH15
MLNPTLMCDFYKLSHREQYPEGTEIVYSTLVPRSNKYYEHSDNIVVFGIQSLVKKYFIDMFNKEFFNRPKEEVINEYKRTVKFTLGQENPDAKHLEQLHDLGYLPIDVRALKEGTVVHPNTPVMTIENTHSDFFWLTNYLETIISTQTWQAMTSATLAYDMRKMLDKYALETVGNIEAVDFQGHDFSMRGMSSLETAQLSSAGHAISFKGSDTVPVVDFLESYYNADVEKEMVVASIPATEHSVMCANGDYETMDEYETYKRMLTEIYPTGVFSIVSDTWDFWGNMTKTLPRLKDIIMERDGKVVIRPDSGDPVKIICGDPDADTEYERKGAVEVLWDTFGGTETEKGYKVLDEHVGLIYGDSINYERAQQICEGLKAKGFASINVVLGVGSFSYQFNTRDTHGFAIKATYAKIKNEEKLIYKNPKTDSGKRSHKGRVAVYKDGSWEDNLNLHQWLNKQNLNQLERVFEDGKLYRDQSLSEIRERIKNN

SEQ ID NO: 43169 - protein, 489 aa, Staphylococcus phage ISP
MLNPTLMCDFYKLSHREQYPEGTEIVYSTLVPRSNKYYEHSDNIVVFGIQSLVKKYFIDMFNKEFFNRPKEEVINEYKRTVKFTLGQENPDAKHLEQLHDLGYLPIDVRALKEGTVVHPNTPVMTIENTHSDFFWLTNYLETIISTQTWQAMTSATLAYDMRKMLDKYAMETVGNIEAVDFQGHDFSMRGMSSLETAQLSSAGHAISFKGSDTVPVVDFLESYYNADVEKEMVVASIPATEHSVMCANGNYETMDEYETYKRMLTEIYPTGIFSIVSDTWDFWGNMTKTLPRLKDIIMERNGKVVIRPDSGDPVKIICGDPDADTEYERKGAVEVLWDTFGGTETEKGYKVLDEHVGLIYGDSINYERAQQICEGLKEKGFASINVVLGVGSFSYQFNTRDTHGFAIKATYAKIKNEEKLIYKNPKTDSGKRSHKGRVAVYKDGSWEDNLTLHQWLNKQNVNQLERVFEDGKLYRDQSLSEIREIIKNN

SEQ ID NO: 43170 - protein, 489 aa, Staphylococcus phage JD007
MLNPTLMCDFYKLSHREQYPEGTEIVYSTLVPRSNKYYEHSDNIVVFGIQSLVKKYFIDMFNKEFFNRPKEEVINEYKRTVKFTLGQENPDAKHLEQLHDLGYLPIDVRALKEGTVVHPNTPVMTIENTHSDFFWLTNYLETIISTQTWQAMTSATLAYDMRKMLDKYAMETVGNIEAVDFQGHDFSMRGMSSLETAQLSSAGHAISFKGSDTVPVVDFLESYYNADVEKEMVVASIPATEHSVMCANGNYETMDEYETYKRMLTEIYPTGIFSIVSDTWDFWGNMTKTLPRLKDIIMGREGKVVIRPDSGDPVKIICGDPDADTDYERKGAVEVLWDTFGGTETEKGYKVLDEHVGLIYGDSINYERAQQICEGLKEKGFASINVVLGVGSFSYQFNTRDTHGFAIKATYAKIKNEEKLIYKNPKTDSGKRSHKGRVAVYKDGSWEDNLTLHQWLNKQNVNQLERVFEDGKLYRDQSLSEIREIIKNN

SEQ ID NO: 43171 - protein, 489 aa, Staphylococcus phage K; identical to SEQ ID NO: 43169

SEQ ID NO: 43172 - protein, 325 aa, Staphylococcus phage LH1; identical to SEQ ID NO: 30484

SEQ ID NO: 43173 - protein, 315 aa, Staphylococcus phage LH1; identical to SEQ ID NO: 35728

SEQ ID NO: 43174 - protein, 489 aa, Staphylococcus phage MSA6; identical to SEQ ID NO: 43169

SEQ ID NO: 43175 - protein, 489 aa, Staphylococcus phage P4W; identical to SEQ ID NO: 43163

SEQ ID NO: 43176 - protein, 163 aa, Staphylococcus phage phi13
MLKRSLLFLTVLLLLFSFSSITNEVSASSSFDKGKYKKGDDASYFEPTGPYLMVNVTGVDGKGNELLSPHYVEFPIKPGTTLTKEKIEYYVEWALDATAYKEFRVVELDPSAKIEVTYYDKNKKKEETKSFPITEKGFVVPDLSEHIKNPGFNLITKVIIEKK

SEQ ID NO: 43177 - protein, 312 aa, Staphylococcus phage phi2958PVL; identical to SEQ ID NO: 30391

SEQ ID NO: 43178 - protein, 325 aa, Staphylococcus phage phi2958PVL; identical to SEQ ID NO: 30484

SEQ ID NO: 43179 - protein, 315 aa, Staphylococcus phage phi5967PVL; identical to SEQ ID NO: 35728

SEQ ID NO: 43180 - protein, 325 aa, Staphylococcus phage phi5967PVL; identical to SEQ ID NO: 30484

SEQ ID NO: 43181 - protein, 315 aa, Staphylococcus phage phi7247PVL; identical to SEQ ID NO: 35728

SEQ ID NO: 43182 - protein, 325 aa, Staphylococcus phage phi7247PVL; identical to SEQ ID NO: 30484

SEQ ID NO: 43183 - protein, 257 aa, Staphylococcus phage phiNM3; identical to SEQ ID NO: 31220

SEQ ID NO: 43184 - protein, 312 aa, Staphylococcus phage phiPVL108; identical to SEQ ID NO: 30391

SEQ ID NO: 43185 - protein, 325 aa, Staphylococcus phage phiPVL108; identical to SEQ ID NO: 30484

SEQ ID NO: 43186 - protein, 312 aa, Staphylococcus phage phiPVL-CN125; identical to SEQ ID NO: 30391

SEQ ID NO: 43187 - protein, 325 aa, Staphylococcus phage phiPVL-CN125; identical to SEQ ID NO: 30484

SEQ ID NO: 43188 - protein, 325 aa, Staphylococcus phage phiSLT; identical to SEQ ID NO: 30484

SEQ ID NO: 43189 - protein, 312 aa, Staphylococcus phage phiSLT; identical to SEQ ID NO: 30391

SEQ ID NO: 43190 - protein, 312 aa, Staphylococcus phage PVL; identical to SEQ ID NO: 30391

SEQ ID NO: 43191 - protein, 325 aa, Staphylococcus phage PVL; identical to SEQ ID NO: 30484

SEQ ID NO: 43192 - protein, 161 aa, Staphylococcus phage SA1
MNYMEIRPFDTANGEGVRVSLFVAGCKHHCEGCFNRESWKFNAGKEFTYANLYGIIKLMDDNAISGLSILGGEPLDDRNIQEVTNICKRIKTVYPEKSIWLWTGFQLHEKIHLDVMKYVDVVVDGKYDASKPTVKPYRGSDNQNLWRKEYGWQGDCQWRAE

SEQ ID NO: 43193 - protein, 593 aa, Staphylococcus phage SA1
MTKSLYAVPAGLNADAYKSGHVYQYPSATEYLMFNLTPRSDKWFNSPLAIDGVVAFGIQRFVKDYLIDHWNATFFERDKKEAIDEILEVMNGVLGKDAIGREHWGALHDLGYLPVEVYAVEEGTVVPMRVPMIVFQNTVSGFHWVAGYLEDAFSAEIWKACTIATIALHYKRICKKWADLTCDNDLHLPYQCHDFAMRGMSGFTDDAFNAVGHLTSFKGTDSFPAVYTAKRIYGQSYPISDIGSSVPATEHSVMCANIAWEGGNELIEEERRFKGELQTFRRFLTETYPTGIVSVVSDTYNFWRTVSEILPALRKEIMERDGKLVIRPDSGDPVHIVTGYKAIHLECAKKAYYEHLSKLEASDTMLNAVLNMKLENISYGIAGWLLSEGYEMVVDREDFEVADTVMLKNAYMVGSANVVTRPVAEIDGAIKTLYNIFGGTINSKGFKVLDEHIGLIYGDSITLERANEILKRLYEMGFASSNVVFGVGSYTYQYMTRDTFAFAVKATLASIGGKEIMLAKDPKTDSGVKKSAFGGVAPMWDSDKLKAVDGYGFQSFADVLDHPACALRLVFSDSEQFGYTTLGDIRNNIDKQL

SEQ ID NO: 43194 - protein, 489 aa, Staphylococcus phage SA5; identical to SEQ ID NO: 43169

SEQ ID NO: 43195 - protein, 489 aa, Staphylococcus phage Sb-1
MLNPTLMCDFYKLSHREQYPEGTEIVYSTLVPRSNKYYEHSDNIVVFGIQSLVKKYFIDMFNKEFFNRPKEEVINEYKRTVKFTLGQENPDAKHLEQLHDLGYLPIDVRALKEGTVVHPNTPVMTIENTHSDFFWLTNYLETIISTQTWQAMTSATLAYDMRKMLDKYAMETVGNIEAVDFQGHDFSMRGMSSLETAQLSSAGHAISFKGSDTVPVVDFLESYYNADVEKEMVVASIPATEHSVMCANGNYETMDEYETYKRMLTEIYPTGIFSIVSDTWDFWGNMTKTLPRLKDIIMERNGKVVIRPDSGDPVKIICGDPDADTEYERKGAVEVLWDTFGGTETEKGYKVLDEHVGLIYGDSINYERAQQICEGLKEKGFASINVVLGVGSFSYQFNTRDTHGFAIKAPYAKIKNEEKLIYKNPKTDSGKRSHKGRVAVYKDGSWEDNLTLHQWLNKQNVNQLERVFEDGKLYRDQSLSEIREIIKNN

SEQ ID NO: 43196 - protein, 176 aa, Staphylococcus phage SpaA1; identical to SEQ ID NO: 28682

SEQ ID NO: 43197 - protein, 489 aa, Staphylococcus phage Staph1N; identical to SEQ ID NO: 43163

SEQ ID NO: 43198 - protein, 165 aa, Staphylococcus phage StB27
MPKVPVKKVRYGNRGMWLENAIIHTNKQYRAKQLARIDKVPTDISYNTRTNKAYYKSKSTVDFTGLDKEGRFIAFDTKNTNGTSLPLSNIKQHQVDYLQEVKAMNGSAFFLIYFSKYKELYRLDIATYLSAIKVLDRKSIPYSFFDEFELVRSKNGILFDYLGVG

SEQ ID NO: 43199 - protein, 315 aa, Staphylococcus phage tp310-1; identical to SEQ ID NO: 35728

SEQ ID NO: 43200 - protein, 325 aa, Staphylococcus phage tp310-1; identical to SEQ ID NO: 30484

SEQ ID NO: 43201 - protein, 222 aa, Staphylococcus phage Twort
  strain DSM 17442
MKKTILASLVLGTALTFGGISDKASADEIDYATLANKAQTNSEDLVTKPIQEGNYDFSFVLEGFTYHFYSYNGYFGYDYHQGTDGQVNNTSSQLASLEQNNTKNNVEYTTENKEQHTQPITIQEPQNKSTQVGTVKLGNGNTAGETGLSASKEMEARTGVPASTWEAIIARESNGQVNAQNPSGARGLFQTMPGWGSTATVQDQINSATKAYKAQGLSAWGM

SEQ ID NO: 43202 - protein, 322 aa, Staphylococcus prophage phiPV83; identical to SEQ ID NO: 30469

SEQ ID NO: 43203 - protein, 308 aa, Staphylococcus prophage phiPV83; identical to SEQ ID NO: 30468

SEQ ID NO: 43204 - protein, 190 aa, Staphylococcus pseudintermedius; identical to SEQ ID NO: 30534

SEQ ID NO: 43205 - protein, 310 aa, Staphylococcus pseudintermedius
MVKNKLLAATLSISLVLPLITPYSEEAKAANTIEEIGEGAQIIKRTEDVSSRKWGVTQNIQFDFVKDPKYNKDALIIKMQGFIKSRTSFTDVKGKGYESTKRMLWPFQYNIALKTNDPNVSLINYLPKNKIESIDVSQTLGYNVGGNFQSAPLLGGKGAFNYSKKISYTQKNYISEVAQQNSKNIRWEVKANSFNTENGQVSAYDRHLFVRSPIGPNARDFFVPNDELPPLIQSGFNPSFIATVSHEKDKGDTSEFEIAYGRNLDITYATFFPRTGIFAERRHNALMNRNLVTKYEVNWKTHEIKVKGHN

SEQ ID NO: 43206 - protein, 462 aa, Staphylococcus pseudintermedius
MENKNFFSIRKLSIGVGSCLIASSLLVNTPSFAEEGDNNAEAQQNAFSEVVKLPNLSEEQRNGFIQSLKDDPSTSQDVLNEAKKLNDSQEGSQPAPDYSDEQQNAFYEILHLPNLTEEQRNGYIQSLKDDPSVSANILVEAKNMNVNQTPTQPAPSFDEAQQNAFYEIVNLPNLTEEQRNGFIQSLKDDPSVSKDILVEAKKLNDSQAKPDYSEAQQNAFYEILHLPNLTEEQRNGFIQSLKDDPSVSSDILAEAKKLNDSQAPKEDNNVKDNNSGENKAEDKGNKENKAEDKGSKEDKAEDKGSKEDKAEDKGSKEDKAEDKGSKEDKAEDKGSIEDKAKDKDNKEGKAADKGMDKAKDAMHVVQPGETVEKIAKANNTTVEQIAKDNHLEDKNMILPGQKLVVDNQKAMKDSQEAKANHEMKALPETGEENDMALFGTSLTGGLSLALGLYILGRGRKTN

SEQ ID NO: 43207 - protein, 1895 aa, Staphylococcus pseudintermedius
  strain ED99
MKKSRKKRIDFLPNRQNRYAIRRFSVGTASILVGATLIFGIHSNDASAAVEDATSQEAGTTNENSNSTEEATTNESTTVEAPTSEEATTEEQSVEAPTSEEVTTEEQSVEAPTSEEVTTEEQSVEAPTSEEVTTEEQSVEAPTSEEVTTEEQSVEAPTSEEVTTEEQSVEAPTSEEVTTEEQSVEAPTSEEATTEEQSVEAPTSEEATTKTPVKEETSSTQENSPTTTLEEQFSNEFNQLTSTEDKTNYTREYLTQNTNLSAEQVEATVERLNLSQENVTAQDIYFALLKDLADQQDALLPRVTLLAARDSELTNEASIALTENSPMFRAALANSPSGNDVVSEEDNIIVADALANGYINSQTDATNAANTLSGRAWVVDTGTPATMSNGLTAVPEGTKVYMQWIDTDGAVSPVYQASTTNKLSSSGGSQVGPGAYAFDLREAWIDSNGKAHRYEASSGQYYRLWIDDYKTVDGNTATMLRQAGGFFPGSYVNSVTGNNIGQFPLIGTNMQRTGIFMGVIPTNDYMTTDTSNWIQDNEGPISNPAVTSTSEFVSGKVWSETGSGDYANSATGPNFNSGDIAREGYQVVMSSLTSAGAQAYKAQVESLPTDQQAAAAHQLFKDHPEFISATVTGKTDANGAYTLRFPSGSLSKDYLYGYVMDNKGNLVKGYSSFTSPLFRSPNSNLSFAPQTAPYHRPAKNAWVNVNFALVETIETSIDITNFDVTANPAQRGDTAIIDVTSTALSPLPTHVEWRDSKGNVVQKSGDVTTVEEAETAGTFTIPDDAKTGEIYTVYIVSGGNEVAADSLIVQVQENAATYEPVYPTTTVEQDQTVTIPTPTNEDGLALPDGTKFEGGNNVPEWATVNEDGSISISPNQDVEKGNYNVPVVVTYPDGSKETVFAPVLVQEAVPTAEQYDPTIETINKEYGTTATEDEIKGAITIPDYPTDGDQPTITIDDPTQIPNGTEEGTVNVGVTVTYPDGSTDKLTVPVVTGKQADNDKYTPETTPITKDFGTGVTEDEVKGAVTVPDYPTDGDQPTITIDDPSQLPDGSKEGTTDVDVTVEYPDGTTDHITVPVTVGKQADNDKYTPETTPITKDFGTGVTEDEVKGAVTVPDYPTDGDQPTITIDDPNQLPDGSQEGTTDVNVTVEYPDGTTDHITVPVTVGKQADNDKYTPETTPITKDFGTGVTEDEVKGAVTVPDYPTDGDQPTVTIDDPNQLPDGSQEGTTDVNVTVEYPDGTTDHITVPVTVGKQADNDKYTPETTPITKDFGTGVTEDEVKGAVTVPDYPTDGDQPTVTIDDPNQLPDGSQEGTTDVNVTVEYPDGTTDHITVPVTVGKQADNDKYTPETTPITKDFGTGVTEDEVKGAVTVPDYPTDGDQPTVTIDDPSQLPDGSQEGTTDVNVTVEYPDGTTDHITVPVTVGKQADNDKYTPETTPITKDFGTGVTEDEVKGAVTVPDYPTDGDQPTITIDDPSQLPDGSQEGTTDVNVTVEYPDGTTDHITVPVTVGKQADNDKYTPETTPITKDFGTGVTEDEVKGAVTVPDYPTDGDQPTITIDDPSQLPDGSQEGTTDVNVTVEYPDGTTDHITVPVTVGKQADNDKYTPETTPITKDFGTGVTEGEVKDSITIPGYPTDGDQPTITIDDPSQLPDGSQEGTTDVDVTVEYPDGTTDHITVPVTVGKQADNDKYTPETEGVNKDHGTSVTEDEVKGAVTVPGYPTDGDQPTVTIDDPSQLPDGSQEGTTDVNVTVEYPDGTTDHITVPVTVGKQPTKDNGATDNDGDMNQGTDEGNSATDHGDNVKQDSNGNYTPVEQRDNHATSPATDMDPMPSNSQTTFDGINAKGSTSEKANHKQQSEQLPDTGESNTQNGALLGGLFAALGGLFLIGRRRKEKEGK

SEQ ID NO: 43208 - protein, 695 aa, Staphylococcus pseudintermedius
  strain ED99
MKDQKQLFSIRKFKRGASSVVIASLFFIGLSHAPALADTEPMTDSSEQKSTEQATNQEAPATKDAIQAKSTAETNHAQEETPASPQAKEASTPTPEKTTKDTSVMSSTKTPSAQQSTETKDLHTYKMQDDTASETDQASSKSVAEAPKETADLKETSEQSPSTAETVIDSDAQVDNDAQKDVLNTVLTSENSAQQTEETLSKNEPTHSQKAHLPSDENRVPTTIDLSADETHQRQELTEQSDNNTKTFNARVAPRAVTTKSVDKNTLVNTKAPKPTKDDVKTLTTANVATTQPQNQQRQAEQVKSQADKKAKQGFYKNNDPIILVHGFNGFTDNINPSVLSHYWGGEKLNIRQDLEENGYNTYEASISAFGSNYDRAVELYYYIKGGTVDYGAAHAAKYGHSRYGKTYEGVYKDWKPGQKVHLVGHSMGGQTIRQLEALLRNGNPEEIAYQKEHGGDISPLFTGNNDNMVSSITTLGTPHNGTHASDQLGNEPIVRQIVFDVAQVLAKNKARVDFGLNQWGLQRKEGESLDDYFNRVANNDQLWRTEDNGFYDLTREGASKLNKKTSLNPNIVYKTYTGEATHPSLSGKQKADYNLFFPFTLTANIIGKAAEKEWRENDGLVSVVSSQHPYNQAWIDATDEVKKGVWQVMPVQHGWDHVDFVGQDTNDTAHSQDELKDFWHKLAEDLVKSEDQTA

SEQ ID NO: 43209 - protein, 488 aa, Staphylococcus pseudintermedius
  strain ED99
MKDQKQLFSIRKFKRGVSSVVIASLFFTTLSITPALANSETMNPSSKKAQETARSSVNNTSYDTLHSKTTSNVQTLNSENKTSSQVQNQNITTQQVKTQDGQKAKQNFYKNRDPIVLVHGFNGFTDNLLPSVYPHYWGGEKLNIRQDLEENGYNTYEASVSAFGSNHDRAVELYYYIKGGTVDYGAAHAAKYGHSRYGKTYEGIDKDWKPGKKIHLVGHSMGGQTIRQLEEYLRNGDPEEIAYQKKHGGKISPVFKGGHDGMISSITTLGTPHNGSHASDKLGNEAIVRQIVFDAAQYLAKNKGRVDFGLKQWGLERKKGESLDAYFERILNNDQLWRTEDQGFYDLTLEGSAKLNKKTSLNPNIVYKTYTGEATHPTLSGKQKADYDMFFLLTVTANVIGKTAEKDWRVNDGVVSVVSSQHPYNQAWVEATDEIQKGVWQVMPVQEGWDHLDFIGLDTNDTSRSQDELKNFWHSIAEDLVKSEETTK

SEQ ID NO: 43210 - protein, 235 aa, Staphylococcus pseudintermedius
  strain ED99
MKKSLLLTTTLAATIGTAGLAASGHDANAAEQGIDQVKLAAMAQHNDPSLNQHPIEEGSYEYNFTLDGVSYNFWSNGVQFGWSYNGFGQATQDYSSIAQPTQMADVSGLASQQSYSNGPSTTQQATSQAPKQQTAPSYTTQSTSTRSVKLANGNTAGSYGTRAAQEMASRTGVSASVWETIIARESNGQLHARNASGASGLFQTMPGWGSTSTYEGQIAAATKAYNAQGLSAWGM

SEQ ID NO: 43211 - protein, 347 aa, Staphylococcus pseudintermedius
  strain ED99
MENKNFFSIRKLSIGVGSCLIASSLLVNTPSFAEETDNANINDAQQNAFYEILHLPNLTEEQQNGFIQSLKDDPSVSNDILVEAKKLNDTQAKPDYSEAQQNAFYEILHLSNLTEEQQNGFIQSLKDDPSVSNDILVEAKKLNDTQAKPDYSEAQQNAFYEILHLSNLTEEQQNGFIQSLKDDPSVSKEILAEAKKLNDSQAPKVDKAKKTDKAEAKADDKAKGEEAKKSEDKKDSKADKAKSKNATHVVKPGETLDNIAKDHHTTVDKIAKDNKIKDKNVIKLGQKLVVDKQKATQGKQEAVAKNEVKALPNTGENDDIALFSTTVAGGVSIALGSLLLGRNRKTS

SEQ ID NO: 43212 - protein, 462 aa, Staphylococcus pseudintermedius; identical to SEQ ID NO: 43206
  strain ED99

SEQ ID NO: 43213 - protein, 930 aa, Staphylococcus pseudintermedius
  strain ED99
MYKNEEEKHSIRKLSIGAASVIVGGLMYGVLGNDEAQANEDVTETTGRNSVTTQASEQHLQVEAVPQEGNNVNVSSVKVPTNTATQAQEDVASVSDVKAHADDALQVQESSHTDGVSSEFKQETAYANPQTAETVKPNSEAVHQSEYEDKQKPVSSSRKEDETMLQQQQVEAKNVVSAEEVSKEENTQVMQSPQDVEQHVGGKDISNEVVVDRSDIKGFNSETTIRPHQGQGGRLNYQLKFPSNVKPGDQFTIKLSDNINTHGVSVERTAPRIMAKNTEGATDVIAEGLVLEDGKTIVYTFKDYVNGKQNLTAELSVSYFVSPEKVLTTGTQTFTTMIGNHSTQSNIDVYYDNSHYVDGRISQVNKKEAKFQQIAYINPNGYLNGRGTIAVNGEVVSGTTKDLMQPTVRVYQYKGQGVPPESITIDPNMWEEISINDTMVRKYDGGYSLNLDTSKNQKYAIYYEGAYDAQADTLLYRTYIQSLNSYYPFSYQKMNGVKFYENSASGSGELKPKPPEQPKPEPEIQADVVDIIEDSHVIDIGWNTAVGEESGANQGPQEEITENHDIEVIEENNLVEMTEDTAVGEESGANQGPQEEITENHDIEVIEENNLVEMTEDTALEEESGANQGPQEEITENHDIEVIEENNLVEMTEDTALEEESGANQGPQEEITENHDIEVIEENNLVEMTEDTAVGEESGANQGPQEEITENHDIEVIEENNLVEMTEDTAVGEESGANQGPQEEITENHDIEVIEENNLVEMTEDTALEEESGANQGPQEEITENHNIEVIEENNLVEMTEDTAVGEESGANPGPQEEVTENQPQQEEIMENQEVEKKGDSNLVESTKTPKAEESVSVQPTLEDKNTKNHVNTVVVNTKVSEVKEKDPHHTKALPDTGTTSRSHSMMIPLLLVAGSVVLLRRKKKHSKVN

SEQ ID NO: 43214 - protein, 1440 aa, Staphylococcus pseudintermedius
  strain ED99
MNKSRTKHFNFLSKRQNRYAIRHFSAGTVSVLVGAAFLLGVHTSDASAAEQDQTSEAKQNLFDASAIFGALTETNEKVAQVTPTEKNLSSVEEMRDKGATGNGPSITSLQTVEQNNAVQPTATPINDTENSTEAPMKEQSNDAQTTDESNNATQKNNTEPQANNEISARNAKTTAYLTSETFTTATSTTDMPTQKQEYPSLENPTNQSQTNRAQPPTMEAPKLAEGLDNLLKKSTFESMYVTKRNQFDKETASKTKAWPSDVVPENQVEILADAIQNGYIKSVNDVTNKAHTLSGRAWMLDHGTPTTIANGLTPVPEGTKVYLRWIDQDGATSPMYTAKTTSRLSAADGNQVGPGAYAFDLRTGWIDAKGKHHVYRAVKGQYYKIWINDFRTKDGNIATMLRVAGGYVPGTYVDSVTYNNMGQFPLIGTNMQRTGIFMTTIPSEKYLISKHYVKDTKGAAANPAVTIIENNFVSGKVWIETGAGDYVNSATGPNHNAKDVVASGYKVVMSSLTDQGAKAYDAQVNRLPKKDRAEAARQLLIKHPEYIAATVEGITNEWGRYTLRFPKGTFNKDHLYGYVLDFDGEIVKTYSGFTSPEFRRPNYNLTVTPQTAPYYRPVRRAWVNVNFAVIEAPQSQIEIKEFDATSNPAHRGQTATIDIIGMPKTSLLTRVQWKDSSGSIVEDSGPVFTEEEAEHIAEFVIPSSAKSGEVYTVQLVVGNHIVASDSLIVHVNEEAATYHPIYPSTTVESGQRVTIPAPKNMDGKPLLDGTTFEKGHHVPTWALVNGDGSITVKPGEKVAEGEYDIPVIVTYPDGSKNTIFAPVTVEEKQPMASQYEPITTGVSKPFGNPVMPTDVTDSIQVPNYPLEGQQPTVTVDDESQLPDGTTEGYKDIDVTVTYPDGTKDRVKVPVVTEQQLDSDKYDPVATGILKPFGTPTTEEDVIKLVEIPKYPTDLTQPKVTVTVPNTLPDGQTPGKVDVDVTVTYPDGSTDHISVPVWTNKHLDKDKYNPITTGVSKPFGIPVTPTDVTDSIQVPNYPLEGQQLTVTVDDETQLPDGTTEGHKDIDVTVTYPDGTKDHIKVPVVTEKQSDNEKYEPTTNGITKKYGIPTTEDEVIDIVRIPYFPVDGVQPIVTVNDPRLLPNGQKEGQINVPVTVTYPDGTKDLMTVPVITGKQAENEKYDPITLGVTKDYGDPTTANDVTKSIQIPTYPAGGEQPIATADDESQLPDGTVEGKVDIPVTVTYPDGTQDHITVPVFTNQQRDNQKASKAVTKIHGISVTGTDMTDTKKNHNYPAGGEQPKVTVKDDDQLSEGKVDSTVGADNVTTTDDLSSVTAVSHGHQTSVQTTKENQSVHDEEVTIPTVAHVSTIMTGVVKGEQEATDIVARPHVETTQLPSISAQATVKKLPETGENNEQSGVLLGGFIAFMGSLLLFGRRRKPKKD

SEQ ID NO: 43215 - protein, 423 aa, Staphylococcus pseudintermedius
  strain ED99
MIEHGQKFDQDVLAQTGTALANVGKLTFKQSGQQFSNAEASLLNVKNLAKLQPDAAVKAQVDKANEAFLKATSEVIIPNNTVDFQGERDDVRTHETNLGNAITDAMEAYGQKGFSRPSDFAVTNSGGIRASIAKGKVTLNDVITVLPFGNTIAQISVKGSDVWKAFEHSLSAPTMTTGGETQLSANGGLLQVSKSIQVYFDMNKAPGERINAIRVLNKQTGQFEDLDMSRTYAVAMNDFTASGGDVFDMFGGPREEGISLEQVFANYLKTADLSQYATTAPQRIINGKPAQNSEMPKITPPSSKGDNVILFPQTKRSKVVPMTKVPTAEGQSQQTAMHVASEHRGMAQSMVPAVSMISTDATGKMAQAHRVMTQNVSALGHHEAKNDAQQLPNTGATEQAPIVGGLFMLGAGLVIMRRQKHHA

SEQ ID NO: 43216 - protein, 1566 aa, Staphylococcus pseudintermedius
  strain ED99
MFNQQKQHYGIRKYAIGTSSVLLGMTLFITHDATASAAENNTTAKTETNQAATISSRTSPTDVAQPNADTNATTATKETTPQSDSTALPQAAAQPQTGQTASKDTVDTNKTQTADSTTAPPVTDAPKANDDTTQPEAATVAKKEDAQTPSTADPTPQAQQPPQSKAPQETQQQSTVEDTTPQQNASTEAHPKNVDTASTKQQQTTPSTAPTPYTQQADEAMTDVTTTSVDSNVQPLAPAEDQPKNTNTADKATVATPPRDNAKTADPNKKMTRAATTQQDDAVDTLKSKEMTATIDKSFPAVKYYTLKNGKKVDAQLTDARQIIVNGEVITPTVKYNKIDDHTAEYDLTAQNDSRSIDANFKFRLSVEGKTVDLQMTDYTNNNTDPQNVIRNFSFVSQSLVSVNNQQKNAKLQTSKLSTNTMKSGDKSYHIDENFKNDFNDFMMYGFVSNDDYSAGLWSNAQIGVGIGEQDFLRVYAQSIQTDIGVAVGLGSMPWFIQKDAAHPDAKNQGLLPHVKVAIAEDENQDGEINWQDGAIAYRSIMNNPYGAEEVPDLVGYRIAMNFGSQAQNPFLKTLDGVKKFYLNTDGLGQSILLKGYNSEGHDSGHLDYANIGQRIGGVKDFKTLLQKGADYGARFGLHVNASETYPESQAFNPALLRKDANGNYMYGWNWLDQGFNIDADYDLIHGRKERFEALKQIVGDDLDFIYVDVWGNGQSGDNTAWPSHQLAKEINDLGWRVGVEWGHGMEYDSTFQHWAADLTYGSYQNKGINSEVARFLRNHQKDSWVGNYPKYSGAADFPLLGGYDMKDFEGWQGRNDYSAYIKNIFNVDVPTKFLQHYKVMRIVDGEPVKMTANGQTIDWTPEMQVDLQNEAGDQVTVKRKSNDYENDTDNYRSRTIELNGRTVLDGDSYLLPWNWDANGQPLTGDNEKLYHWNKKGGSTTWTLPESWDTDQVVLYELSETGRKSPRTVAVKDHQVTLDNIKADTPYVVYKVAQPDNTDVNWSEDMHVKDAGFNSQQLTPWTIEGNRDKVSIEKSTTSNEMLKIDSPTKTTQLTQQLTGLVPGQRYAVYVGIDNRSDAAAHIAVTHNGKTLASNETGQSIAKNYVKADAHSNNAATFKNGGSYFQNMYVYFVAPEDGKADLTIQRDPGEGATYFDDIRVLENNANLLQNGTFNQDFENVPQGLFPFVVSEVEGVEDNRVHLSEKHAPYTQRGWNNKRVDDVIDGKWSLKVNGQTGKDKMVIQTIPQNFYFEPGKTYEVSFDYEAGSDDTYAFATGSGDISKNRNFEKTPLKNTVDGGKAKRVTFKVTGDENGQTWIGIYSTKTPNDPRGVKNGNQINFEGTKDFILDNLSIREIDAPKPDATQESGDSAPMNETDERNVNSNGTLADHSETTDVNVSATADDTAVKGEMTTNRTDAPTVTLPEATIVDEGTSNPVTTTPTNTTQAMTNKADEMPQTMNNVPLTSIATDMMQSHAVDSMAATLAATNQVAAPVRQTAGPMQHGMDSASTQHAPIQVDNVTAPPLPDEQFAELPKTGDTTPNTRGPLMAMIVGAVLTAFGFRRQRKEK

SEQ ID NO: 43217 - protein, 1031 aa, Staphylococcus pseudintermedius
  strain ED99
MITNKNIYSIRKHKLGVASFLLGTLFVVGHANNAEASEVSATTQEHNVETEQTKTEGELTTEVAQQAVSESAPIAENMQKTTSVASENAKEVTASDSTQEVTKTEAKDTATMKDSEIAQPVSEVNKPVTQTAAPVAEPSTANKQTSPRQVQELTAPMDTKVINVENGTDVTSKVKVEKSSITGHQNKDKTYHQSNTVNPHKAERVTLNYDWSFENGIKAGDYFDFQLSDNVDTNGISTIKKVPHIMDSQNSEQIIAYGEINENNRVRYRFMDYVNQKENLKGKLSLNLFIKPDKVQDEGKITVTSQLGKEMTSQEFDIKYIDGVKSPSGITLNGRLDELSKADQSFTHYSIFKPKHNNLTNVTLRGTVSNNAQQNEKNGQVNVYEYIGQGELPQSAYANVNDTKQFNDITKSMKSIKNNSNGYEITFDMNKDNHPYIIVYQGHFNNNAKDFDFSTNATGYQNLNQSEYSYYWPYNYSFNLTWDNGVAFYSNNASGEGNDKPVPPTYGYSPTVNTIQDTHADYPVMTFQQPGTLEETEDSMPITTLTESGEDRGENTSPIIETTEDSQPVEFEEETNHGIQDVTLHADAVDFEEETNHGEQDTVHHSDVVEYDEDTTTGMLTGAISDHTTEEGTMEYTTDGLLIEFDDEMNPNVSGQYDDITTDTIEESSHIDTFTELESEFGQHDGIVTFEEDTIVEKPKTEKGNRVPLVIDLSTPKHNHQFNIQPTDPNIDTSATYRIGNFVWRDEDHNGVQNDGEHGLEGVLVTLKTADGVVLNTTTSDANGHYQFTNVQKGKYIVEFTTPEGYEATSKHTTANTEKDSDGLIANIDVTQDDMSIDAGFFPLENWNPQPEPKNPDDREKPAPEQPDVPQPEPKNPDDREKPAPEQPDVPQPEPKNPDDREKPAPEQPDVPQPEPKNPDDKEKPAPEQPDVPQPEPKNPDDKEKPAPEQPDAPQPKPMLPGEKVKPKPTHPGEAMQTTPQDKSTSQTDEALPKTGESSSQSSALIFGGLLSLLGLGLLRRSSKQNRSSMK

SEQ ID NO: 43218 - protein, 326 aa, Staphylococcus pseudintermedius
  strain ED99
MKISKVIKAATATSVALMLFSNPVYAANQITPVSEKKVDDKITLYKTTATADSDKLNISQLLTFNFIKDKSYDKDTLVLKAAGNINSGYKSPNPNDYIYSSFYWGAKYNVSISAESKGAVNVVDYAPKNQNEEFQVQNTLGYSFGGDISISKGLSGGLNGSESFSETINYKQESYRTTIDKHTDNKTIGWGVEAHKIMNAGWGPYGRDSFHDLYGNELFLGGRQSKLNAGQNFLPTSQMPLLARGNFNPEFLSVLSHKPNGAKTSKIKVTYQREMDEYTNYWNGFHWMGTNYKNQNNATFTSFYEIDWDQHTVKLIKTHSDEKNPS

SEQ ID NO: 43219 - protein, 310 aa, Staphylococcus pseudintermedius; identical to SEQ ID NO: 43205
  strain ED99

SEQ ID NO: 43220 - protein, 247 aa, Staphylococcus pseudintermedius
  strain ED99
MKAKKLLATGLALGILTSTASLYTDHEAQAASKQHHQVKTSSIPYSTTIDGATPFVQSYLKLSNENVSNFKQLNQKVKSTLKQDYKISATQIEKSKTAQYTVTWKNGKKQTISLKNDAALSAQKLNVKDIQQIDIVVKNKTAKQDVKSVPYTVTIDGQTAYVQSFLNISNKNVTNFYQLNQKVKSALNNEYQLSNKDINRAKTAKYTVTWNNGKKQTINLKSHAQLPGNQISGKDIKNIDIEVVSAK

SEQ ID NO: 43221 - protein, 1144 aa, Staphylococcus pseudintermedius
  strain ED99
MSTEKQDDTQAKANALSTDDSTPTTEQSKSDTEPTQNQEVNEKEATQVEQTPDNASSEFKDSAAQDETTSKDADIAQTKEAKNEALQSDSSANLSNQEAEKENTTNSESQVNEQPKADTTSDSQVSNTPQQDPTSTVPSPETSEDNRPSTELKNSETTASQTTLNEQPTESTSNQTETTKAPTNTTVANKKAPAQLKDIKGTTQLRAVSASQPTAVAAGGTNVNDKVTASNMKITESYIEPNNSGNFYLKSNFNVNGTVKEGDYFTVKMPDTVNTFGDTRHSPDFREKITNQKGEVVALGEYDVANHTMTYTFTNVVNNLENVSGSFNLTQFMDRKVATDSQTYPLKYDIAGESLDTQIKVNYGQYYSEGDSNLKSMITSEDPKTGEYDQYIYVNPLQKTANGTVVRVQGFQVDPTKSNGQVKPDTTQIKILKVADGQPLNSSFGVNDSEYEDVTKQFNIVYRDNNLADIYFGNLNGQRYIVKVTSKENLDSKEDLNLRAIMATQNRYGQYNYITWDNDIVKSSSGGTADGNEASYQLGDKVWNDVNKNGIQDQGETGIADVKVTLKDLDGNILDTTYTNTNGKYIFDNLKNGNYQVGFETPEGYAASPSNQGNDALDSDGPTNVQAVISDGNNLTIDQGFYQTETPTHNVGDKVWEDLNKDGIQDQNEPGIANVKVTLKDADGNVVDTRTTDDKGNYLFEKVKEGEYTIEFETPEGYTPTQTGQGRVSTDSNGTSSLILVEGNDDLTIDSGFYKEPVTHKVGDKVWDDLNKDGIQDDNEPGISDVKVTLKDADGNVVDTRTTDANGNYLFENVKEGDYTIEFETPEGYTPTVTGQGTADNDSNGTSTKVTVKDGDDLTIDSGFTQVTPEPPTHNVGDKVWDDLNKDGIQDDNEPGISDVKVTLKDADGNVVDTRTTDANGNYLFENVKEGDYTIEFETPEGYTPTVTGQGTADNDSNGTSTKVTVKDGDDLTIDSGFTQVTPEPPTEPENPSPEQPSEPGQPENPSPEQPSEPGQPENPSPEQPSEPGQPENPSPEQPSEPGQPENPSPEQPSEPGQPKNPSPEQPNNPSVPGVQNPEKPSLTPVTQPVHSNGNKAKPSQQQKALPETGETESHQGTLFGGILAALGALLFARKKRHDKKQSH

SEQ ID NO: 43222 - protein, 264 aa, Staphylococcus pseudintermedius
  strain ED99
MNKKRFVISLLFSITILFVISSSTALADHTLDPTPDQLHKSSEFKGLMGNVKYLYDRNFISESNVKSIDSLLAHDLIFCIRESEIKEYGLVKTEFASKELAQKYRNKQVDIFGANYYVDCYFSGKEKGNEEDNGKTCMYGGVTNYEGNHLDNHKSQTIYVKVFENSKHIITFEIQADKKLVTAQELDAKARKFLIDKLNLYEFKGSPYETGYIKFIENDDKSFWYDLMPPPGNNFNQSKYLTMYSDNKTVESKDIKIEVHLTKK

SEQ ID NO: 43223 - protein, 434 aa, Staphylococcus pseudintermedius
  strain ED99
MPIITDVYAREVLDSRGNPTVEVEVLTESGAFGRALVPSGASTGEHEAVELRDGDADRYLGKGVEKAVENVNEIIAPELIEGEFSVLEQVSIDKMMIQLDGTANKGKLGANAILGVSIAVARAAADFLGQPLYKYLGGFNATVLPTPMMNIVNGGSHSDAPIAFQEFMILPVGAESFKEALRWGAEVFHALAKILKKRGLVTAVGDEGGFAPKFEGTEDGVETILEAIKAAGLEPGKDVFLGFDCASSEFYENGVYDYTKFEGENAAKLTAEEQVDYLEQLVNKYPIITIEDGMDENDWEGWKLLTERIGDRVQLVGDDLFVTNTEILSKGIEQGIGNSILIKVNQIGTLTETFEAIEMAQKAGYTAVVSHRSGETEDTTIADIAVATNAGQIKTGSLSRTDRIAKYNQLLRIEDDLYETAKYEGLKSFYNLSK

SEQ ID NO: 43224 - protein, 330 aa, Staphylococcus pseudintermedius
  strain ED99
MKKLKQKKRLTSLLLATTMLLGIMNTGVSHAASDENQAELKLATHNVYMLSGFLYPNWGQSKRADLISKSKYIQDNDVVIFNEAFYPASANQLFNNLKSSYPYQTAVLGRSTSGWDRTEGHYSSTTFENGGVAIVSKYPIRERIQHIFQHGCGFDNDSNKGFVYTKIEKNGKFVHVIGTHTQSEDTRCSVGQDRAIRAEQMKEISNFVKSKNIPKDEVVYIGGDMNVNKNAGNGEFQDMLKNLNVSDVTYTGHSSTWDPQSNSIAKYNYPNSAPEYLDYIFVDKDHRQPGQLINEAVAEKSPTWDVYKFPYLYVYNDYSDHYPVKAYSKS

SEQ ID NO: 43225 - protein, 1846 aa, Staphylococcus pseudintermedius
  strain ED99
MKSKYDFLPNRLNKFSIRKFTVGSVSVLIGATLLFGFVEGEASASVKEGQQSINSSEKESADPTVVDLISKKETNLDGLDVSREETTKVPINENKRGEEQSISDKAITEKADTPVSNLSSKEVEEQGVSDKAITEKADTPVTNLSSKEAKEQGASDRVITEKADTPVSNLSSKEAKEQGASDRVITEKADTPVSNLSSKEVEEQGVSDKAIEKIADASATDLSSKEEVEQDISTQGKVKSKEAVQVESSQLQNLNSEINAEPNEIKAIDRSSILPLNLNDEENNKKVNKGTRVPEATLRNASNNQLNTRMRSVSLFRVARLTEINRNVNDKVKVSDIDIAIAPPHTNPKTGKEEFWATSSSVLKLKASYELDNSISKGDQFTIQFGQNIRPGGLNLPRPYNFLYDKDKKLVATGRYNKESNTITYTFTDYVDKHQNIKGSFEMNAFSRKENATTDKTAYPMDVTIANQKYSENIIVDYGNKKNAAIISSTEYIDLDGSRKMTTYINQNGSKNSIYRADMQIDLNGYKFDPSKNNFKIYEVENSSDFVDSFSPDVSKLRDVTSQFNIQYTNNNTMAKVDFGTNLWRGKKYIIQQVANIDDSKLVKNASINYTLNKMDFNNKRTVETHNNTYSTVKDKSTALGDVQESQSISESQSVSESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSVSESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSVSESESLSESQSISESESLSESQSISESESLSESQSISESESLSESQSISESESLSESQSISESESLSESQSISESESLSESQSISESESLSESQSVSESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESLSESQSISERESLSESQSISESESLSESQSISESESLSESQSISESESLSESQSISESESLSESQSISESESLSESQSISESESLSESQSISESESLSESQSISESESLSESQSISESESLSESQSISESESLSESQSVSESESLSESQSISESESLSESQSISESESLSESQSISESESLSESQSISESESLSESQSISESESLSESQSISESESLSESQSISESESLSESQSISESESLSESQSISESESLSESQSISESESLSESQSISESESKSLPNTGTGEKISNYPGILGGLLSILGISLLKRKDREKKLGQKSNK

SEQ ID NO: 43226 - protein, 684 aa, Staphylococcus pseudintermedius
  strain ED99
MNQYNQKSIYCIRKYTVGVVSVLATMTFLIGGHDAMASEQHTTQASSELARTEVTVSNQSLSEDTHTQSLPQKEGQHSHSGDSKNPKTSLFANASSQEQLPTTPEQGVSSDNPNTSYPTHINENTNVPSLVDIQQEKGEKLSDVPNSEKVKTQSGSQIEESPHSNNRKAGRIAENQDLTSQQSDVALKDQSDVEVSKRVNHRSSEAMRARNVEKAQTDEIDQMTSQNLKPVVKDKTDQGKEQAIAEHKDQTKKGASEEGMTQKETTQEQQSQTRVANSKEVLEKSSTQAQQKQSTNKYPIVLVHGFLGLVGENAPALYPNYWGGNKFKVIEALRKKGYDIHQASVGAFSSNYARAVDLYYFIKGGRVDYGAAHAAQYGHERFGKIYKGIMPDWRPGKKVHLIGHSMGGQTVRLMEELLRNGSKDEIAYHQKHGGTISPLFKGGLTDMVSSITTLGTPHNGSQAADQVANKEFVRHIMYALSRVAGSEYSDFDLGLRHWGFKQRPGESYFDYMKRVSESPIWQTKDNAAYDLTLEGSAILNQKTSLNPNITYTTYTAEASHKGASGKEVPNVGVFPLMDLTSRIIGSDARLEWRKNDGVVAVISSLFPLNQPFVKVSSDALATRRGIWQVRPVLKNWDHVDFIGIDIFDLKRTGGELAKFYMSIMDNLLHIEALDMSPRIKKSAS

SEQ ID NO: 43227 - protein, 234 aa, Staphylococcus pseudintermedius
  strain ED99
MKQSTILKVSLAVGILTTGVGIHSQAAAFASEAHAQNVHSEAQQLKDYYSKTYFEYNSVTGYVEDNNKLSVVTPHGTAVSVSLVGNDLSKYTDKANEYNHLDLFVVPEGTDRSAETKSIGGITRTNQATYHDYVKRPNIVINRTSGIVTSSMSTNDFSINKEEVPLKELDFKLRQKLINEYGLYQNGSSNGKIVIKIGDNDKDIMTLELNKKLQEHRMSDTVDVNKIQQITIDL

SEQ ID NO: 43228 - protein, 264 aa, Staphylococcus pseudintermedius; identical to SEQ ID NO: 43222
  strain HKU10-03

SEQ ID NO: 43229 - protein, 1195 aa, Staphylococcus pseudintermedius
  strain HKU10-03
MKHMNSKSNRTLSRFSIRKCSVGTASFLIGTVAFFGIHHEAFAAENSTTPVTVAQLQDQGDTNEVSTEKPDDTQAKANALSTDDSTPTTEQSKSDTEPTQNQEVNEKEATQVEQTPDNASSEFKDSAAQDETTSKDADIAQTKEAKNEALQSDSSANLPNQEAEKENTTNSESQVNEQPKADTTSDSQVSNTPQQDPTSTVPSPEISEDNRPSTELKNSETTASQTTLNEQPTESTSNQTETTKAPTNTTVANKQAPAQLKDIKGTTQLRAVSASQPTAVAAGGTNVNDKVTASDMGISESYIEPNNSGSFYLKSRFTVDGTVKEGDYFTVKMPNTVNTFGDTRHSPDFTEALKNSNGDVIALGEYDVASHTLTYKFTSAVNNLQNVTGSFNLTQFMDRQVAKESDTYPLDYEIAGEKFDTQIKVHYGQYYRVGDSNLKSMITMEDSKTGEYEQYIYVNPLKRDAYGTVVRVQGFQNDPATSNGQVNPDTTQIKILKVSDGQTLNSSFGVDDSQYEDVTDKFKTVYRDGENLADIFLGDLNGARYIIKVTSKEVSGSSEDLKLRSSMYTKNTYGQYDRLTWDNDIVKSSSGGTADGNEASYQLGDKVWNDVNKNGIQDQGETGIADVKVTLKDLDGNILDTTYTNTNGKYIFDNLKNGNYQVDFETPEGYAASPSNQGNDALDSDGPTNAQAVISDGNNLTVDQGFYQTETPTHNVGDKVWEDLNKDGIQDQNEPGIANVKVTLKDADGNVVDTRTTDDKGNYLFEKVKEGEYTIEFETPEGYTPTQTGQGRVSTDSNGTSSLILVEGNDDLTIDSGFYKEPVTHKVGDKVWDDLNKDGIQDDNEPGISNVKVTLKDADGNVVDTRTTDANGNYLFENVKEGDYTIEFETPEGYTPTVTGQGTADNDSNGTSTKVTVKDGDDLTIDSGFTQVTPEPPTHNVGDKVWDDLNKDGIQDDNEPGISNVKVTLKDADGNVVDTRTTDANGNYLFENVKEGDYTIEFETPEGYTPTVTGQGTADNDSNGTSTKVTVKDGDDLTIDSGFTQVTPEPPTEPENPSPEQPSEPGQPENPSPEQPSEPGQPENPSPEQPSEPGQPENPSPEQPSEPGQPKNPSPEQPNNPSVPGVQNPEKPSLTPVTQPVHSNGNKAKPSQQQKALPETGETESHQGTLFGGILAALGALLFARKKRHDKKQSH

SEQ ID NO: 43230 - protein, 235 aa, Staphylococcus pseudintermedius; identical to SEQ ID NO: 43210
  strain HKU10-03

SEQ ID NO: 43231 - protein, 488 aa, Staphylococcus pseudintermedius
  strain HKU10-03
MKDQKQLFSIRKFKRGVSSVVIASLFFTTLSITPALANSETMYPSSTKAQETARSSVNNTSYDTLHSKTTSNVQTFNSENKTSSQVQNQNIITQQVKTQDGQKAKQNFYKNRDPIVLVHGFNGFTDNLLPSVYPHYWGGEKLNIRQDLEESGYNTYEASVSAFGSNHDRAVELYYYIKGGTVDYGAAHAAKYGHSRYGKTYEGIDKDWKPGKKIHLVGHSMGGQTIRQLEEYLRNGDPEEIAYQKKHGGKISPVFKGGHDGMISSITTLGTPHNGSHASDKLGNEAIVRQIVFDVAQYLAKNKGRVDFGLKQWGLERKEGESLDAYFERILNNDQLWRTEDQGFYDLTLEGSAKLNKKTSLNPNIVYKTYTGEATHPTLSGKQKADYDMFFLLTLTANVIGKTAEKDWRVNDGVVSVVSSQHPYNQAWVEATDEIQKGVWQVMPVQEGWDHLDFIGLDTNDTSRSQDELKNFWHSIAEDLVKSEETTK

SEQ ID NO: 43232 - protein, 695 aa, Staphylococcus pseudintermedius
  strain HKU10-03
MKDQKQLFSIRKFNSGASSVVIASLFFIGLSHAPALADTESTAHSSEQKSTVQATNQEAPATKEATQAKSTAETNHAQEDTPASPQAKEASTPTSEKTTKDTSVMSSTKTPSAQQSTETKDLHTDKMQDDTASETDQASSKSVAEAPKETADLKETSEQSPSTAETVIDSDAQVDNDAQKNVLNTVQTSENSAQQTEETLSKNEPTHSQKAHLPSDENRVPTTIDLSADETHQRQELTEQSDNNTKTFNARVAPRAVTTKSVDKNTLVNTKAPKPTKDDVKTLTTANVATTQPQNQQRQAEQVKSQADKKAKQGFYKNNDPIILVHGFNGFTDNINPSVLSHYWGGEKLNIRQDLEENGYNTYEASISAFGSNYDRAVELYYYIKGGTVDYGAAHAAKYGHSRYGKTYEGVYKDWKPGQKVHLVGHSMGGQTIRQLEALLRNGNPEEIAYQKEHGGDISPLFTGNNDNMVSSITTLGTPHNGTHASDQLGNEPIVRQIVFDVAQVLAKNKARVDFGLNQWGLQRKEGESLDDYFNRVANNDQLWRTEDNGFYDLTREGASKLNKKTSLNPNIVYKTYTGEATHPSLSGKQKADYNLFFPFTLTANIIGKAAEKEWRENDGLVSVVSSQHPYNQAWIDATDEVKKGVWQVMPVQHGWDHVDFVGQDTNDTAHSQDELKDFWHKLAEDLVKSEDQTA

SEQ ID NO: 43233 - protein, 1865 aa, Staphylococcus pseudintermedius
  strain HKU10-03
MKKSRKKRIDFLPNRQNRYAIRRFSVGTASILVGATLIFGIHSNDASAAVEDATSQEAGTTNENSNSTEEATTNESTTVEAPTSEEATTEEQSVEAPTSEEVTTEEQSVEAPTSEEVTTEEQSVEAPTSEEVTTEEQSVEAPTSEEATTEEQSVEAPTSEEVTTEEQSVEAPTSEEATTKTPVKEETSSTQENSPTTTLEEQFSNEFNQLTSTEDKTNYTREYLTQNTNLSVEQVEATVERLNLSRENVTAQDIYFALLKDLADQQDALLPRVTLLAARDSELTNEASIALTENSPMFRAALANSPSGNDVVSEEDNIIVADALANGYINSQTDATNAANTLSGRAWVVDTGTPATMSNGLTAVPEGTKVYMQWIDTDGAVSPVYQASTTNKLSSSGGSQVGPGAYAFDLREAWVDSNGKAHRYKAVSGQYYRLWIDDYKTVDGNTATMLRQAGGFFPGSYVNSVTGNNIGQFPLIGKNMQRTGIFMGVIPTNDYMTTDTSNWIQDNEGPISNPAVTSTSEFVSGKVWSETGSGDYANSATGPNFNSGDIAREGYQVVMSSLTSDGAQAYKAQVESLPTDQQAAAAHQLFKDHPEFISATVTGKTDANGAYTLRFPSGSLSKDYLYGYVMDNKGNLVKGYSSFTSPLFRSPNSNLSFAPQTAPYHRPAKNAWVNVNFALVETIETTVDITNFDVTANPAQRGDTAIIDVTSTALSPLPTHVEWRDSKGNVVQKSGDVTTVEEAETAGTFTIPDDAKTGEIYTVYIVSGGNEVAADSLIVQVQENAATYEPVYPTTTVEQDQTVTIPTPTNEDGSALPDGTKFEDGNNVPEWATVNEDGSISISPNQDVEKGNYNVPVVVTYPDGSKETVFAPVLVQEAVPTAEQYDPTSETINKEYGTTATEDEIKGAITIPGYPTDGDQPTITIDDPSQIPNGTEEGTVNVGVTVEYPDGSKDKLTVPVVTGKQADNDKYTPETTPITKDFGTGVTEDEVKGAVTVPDYPTDGDQLTITIDDPNQLPDGSQEGTTDVNVTVEYPDGTTDHITVPVTVGKQADNDKYTPETEGVNKDHGTPVTEDEVKDAITIPGYPTDGEQPTITIDDPSQLPDGSQEGTTDVNVTVEYPDGTTDHITVPVTVGKQADNDKYTPETTPITKDFGTGVTEDEVKGAVTIPGYPTGGDQPTITIDDPSQLPDGSQEGTTEVNVTVEYPDGTTDHITVPVTVGKQADNDKYTPETEGVNKDHGTPVTEDEVKNSITIPGYPTDGDQPTITIDDPSQLPDGSQEGTTEVNVTVEYPDGTTDHITVPVTVGKQADNDKYTPETTPITKDFGTGVTEDEVKGAITIPGYPTDGDQPTITIDDPSQLPDGSQEGTTEVNVTVEYPDGTTDHITVPVTVGKQADNDKYTPETEGVNKDHGTPVTEDEVKDAVTIPGYPTDGDQPTVTIDDPSQLPDGSQEGTTDVNVTVEYPDGTTDHITVPVTVGKQADNDKYTPETTPITKDFGTGVTEDEVKGAVTIPGYPTGGDQPTITIDDPSQLPDGSQEGTTEVNVTVEYPDGTTDHITVPVTVGKQADNDKYTPETEGVNKDHGTPVTEDEVKNSITIPGYPTDGDQPTITIDDPSQLPDGSQEGTTEVNVTVEYPDGTTDHITVPVTVGKQADNDKYTPETTPITKDFGTGVTEDEVKGAITIPGYPTDGDQPTVTIDDPSQLPDGSQEGTTDVNVTVEYPDGTTDHITVPVTVGKQPTKDNGATDNDGDMNQGTDEGNSANDHGDNVKQDSNGNYTPVEQRDNHVTSPATDMDPMPSNSQTTFDDMHAKDSTSEKANHKQQSEQLPDTGESNTQNGAFLGGLFAALGGLFLIGRRRKEREGK

SEQ ID NO: 43234 - protein, 1178 aa, Staphylococcus pseudintermedius
  strain HKU10-03
  MOD_RES (926)..(926): Any amino acid
MSKSTSTSTSDSDSASTSTSVSDSTSVSLSQSTSVDKDSTAKGSTELVNVASLSISASQSSSLSASTSTSIEKSESTSTSGSNSTNASLSSSASLSTSASTSVSEVTSVTHSENDLSASNDRDTSGSVSQFASENASLSDSASISGEVSSSTSASTSKSSSLSASALHDKHVSESTSASLSSGDSSRASASVSTSLSESDSALIDSESISVSEHTSTLQSDSHSLSQQQSAELSQSEQTSQSQRISTSASVSAMKSESAAKVSESLSTSQSKVDSQSQSVSESASNSRVSRDSKSTSASMRRSLSESVSQSMSLIDQSESDSTSISISTSISDEDSMLYSMSDSASISTKASSSMSTSTSEEHANSHSQSESTASVELSQEMSASASTSKSESQSESVSVSNEESNISSMQESFVESAKASRSASMSVAKSEASESQLLSESNASVSQSASTSSKASASTSESISTSLSVSEATHGKPRNHSESASASQLLEENESLSDSASTSVEDSESASASLSVYQSQSASALKSTHASEKASVNTSANASKRASASTSISNSKSKVIASESKSTSISTYESLSISTSKEQSTRVSVSESTSTSKVKSESDSASTSTSESISISANRSGYTSSKRSVQMSEAQSTSDSLSVMQSEGSVSVSQSLSVSDKTSQSLSESISHSESDSDSNSVSISQETSEQHSVSDSNSTSISESESIAYSQSASESESTSIAKSDSISNSLSVSLSESESEASTSASVSTSESTSVKDSLSTSILNSQSASTHQSKEASQSTSTSKVEEASLSDSASVSDSQSLSMSHEKSQSASTSKSTSLSKTISESESVSASTSTSEAVSTEASEFVSAVDSLSQVTSNGSTTKEDASTFVSTVDSLKDKASNNGTPSEFASAVKSTHASVSVSASESTSASTSTSEAVSXKSVHGSMSTSASVSASESTSASTSTSEAVSTEASEFVSAVNSLSSEASNGSTTREGASTFVSTVDSLKDKASNNGTPSEFESVVKSVHGSMSTSASASTSASTSASTSTSEAVSTEASESASISVSMSVSASTSASMSVSVSNSVSVSDSISVSASTSEPNSVSSSMSSSLSTSASTPSEITSSSSSSDSATVQKVVSKDEQHATNKVEKLPDTGQSTTQTGLLGGVGALLTGLGLLKKSRKQKDEETSSHE

SEQ ID NO: 43235 - protein, 1243 aa, Staphylococcus pseudintermedius
  strain HKU10-03
MITNKNIYSIRKHKLGVASFLLGTLFVVGHANNAEASEVSTTTQEQNAEKEQAKTEGELTTEAAQQTAVESIPASENMQERTLVASENGKEVTTTESTQEVTKTETKDTATMKDSEIAQPVSEVNKPVTQTAPVQTPTTATEHKSPRQVQEVTSPVDTKVINVENGTDVTSKVKVETSSITGHQNNDKTYRQSNTVNPHKAERVTLNYDWSFENGIKAGDYFDFQLSDNVDTNGISTIKKVPHIMDSQNSEQIIAYGEINEKNRVRYRFMDYVNQKENLKGKLSLNLFIKPDKVQDEGKITVTSQLGKEMTSQEFDIKYIDGVKSPSGITLNGRLDELSKADQSFTHYAIFKPKHNNLTNVTLRGTVSNNAQQNEKNGQVNVYEYIGQGELPQSAYANVKDTNQFRDITNSLRPTTVNSTGYQITFDHINKKPYVIVYKGHYKNEAKDLEFTTNATDYHSSNLYSYNYWPYYGSFNLTWKNGVAFYSNKANGEGNDKPVPPTYGFSELVDTTQNTAPATMTFQTTGVLEEIEDSVVLNTLSQSGEDRGENTSPIIETTEDSQPVEFEEETNHGIQDVTLHADAVDFEEETNHGEQDTVHHSDVVEYDEDTTTGMLTGAISDHTTKEDTMEYTTDSLLIEFDDEMNPNVSGQYDDITTDTIEESSHIDTFTELESEFGQHDGIVTFEEDTIVEKPKTEKGNRVPLVIDLSTPKHNHQFNIQPTDPNIDTSATYRIGNFVWRDEDHNGVQNDGEHGLEGVLVTLKTADGVVLNTTTSDANGHYQFTNVQKGKYIVEFTTPEGYEATSKHTTANTEKDSDGLIANIDVTQDDMSIDAGFFPLENWNPQPKDETYTIGDFVWRDEDHNGVQNDGEHGLEGVLVTLKTADGVVLNTTTSDANGHYQFTNVQKGKYIVEFTTPEGYEATSKHTTANTEKDSDGLIANIDVTQDDMSIDAGFFPLENWNPQPKDETYTIGDFVWRDEDHNGVQNDGEHGLEGVLVTLKTADGVVLNTTTSDANGHYQFTNVQKGKYIVEFTTPEGYEATSKHTTANTEKDSDGLIANIDVTQDDMSIDAGFFPLENWNPQPEPKNPDDKEKPAPEQPDVPQPEPKNPDDREKPAPEQPDVPQPEPKNPDDKEKPAPEQPDVPQPEPKNPDDKEKPAPEQPDAPQPKPMLPGEKVKPKPTHPGEAMQTTPQDKSTSQTDEALPQTGESSSQSSALIFGGLLSLLGLGLLRRSSKQNRSSMK

SEQ ID NO: 43236 - protein, 1566 aa, Staphylococcus pseudintermedius
  strain HKU10-03
MFNQQKQHYGIRKYAIGTSSVLLGMTLFITHDATASAAENNTPAKTETNQAATISSRTSPTDVVQPNADTNATTATKETTPQSDSTALPQAAAQPQTGQTASKDTVDTNKTQTADSTTAPPVTDAPKANDDTTQPEAATVAKKEDAQTPSTADPTPQAQQPPQSKAPQETQQQSTVEDTTPQQNASTEAHPKNVDTASTKQQQTTPSTAPTPYTQQADEAMTDVTTTSVDSNVQPLAPVEDQPKNTNTADKATVATPPRDNAKTADPNKKMTRAATTQQDDAVDTLKSKEMTATIDKSFPAVKYYTLKNGKKVDAQLTDARQIIVNGEVITPTVKYNKIDDHTAEYDLTAQNDSRSIGANFKFRLSVEGKTVDLQMTDYTNNNTDPQNVIRNFSFVSQSLVSVNNQQKNAKLQTSKLSTNTMKSGDKSYHIDENFKNDFNDFMMYGFVSNDDYSAGLWSNAQIGVGIGEQDFLRVYAQSTQTDNGVAVGLGSMPWFIQKDAAHPDAKNQGLLPHVKVAIAEDENQDGEINWQDGAIAYRSIMNNPYGAEEVPDLVGYRIAMNFGSQAQNPFLKTLDGVKKFYLNTDGLGQSILLKGYNSEGHDSGHLDYANIGQRIGGVKDFKTLLQKGADYGARFGLHVNASETYPESQAFNPALLRKDANGNYMYGWNWLDQGFNIDADYDLIHGRKERFEALKQIVGDDLDFIYVDVWGNGQSGDNTAWPSHQLAKEINDLGWRVGVEWGHGMEYDSTFQHWAADLTYGSYQNKGINSEVARFLRNHQKDSWVGNYPKYSGAADFPLLGGYDMKDFEGWQGRNDYSAYIKNIFNVDVPTKFLQHYKVMRIVDGEPVKMTANGQTIDWTPEMQVDLQNEAGDQVTVKRKSNDYENDIDNYRSRTIELNGRTVLDGDSYLLPWNWDANGQPLTGDNEKLYHWNKKGGSTTWTLPESWDTDQVVLYELSETGRKSPRTVAVKDHQVTLDNIKADTPYVVYKVAQPDNTDVNWSEDMHVKDAGFNSQQLTPWTIEGNRDKVSIEKSTTSNEMLKIDSPTKTTQLTQQLTGLVPGQRYAVYVGVDNRSDAAAHIAVTHNGKTLASNETGQSIAKNYVKADAHSNNAATFKNGGSYFQNMYVYFVAPEDGKADLTIQRDPGEGATYFDDIRVLENNANLLQNGTFNQDFENVPQGLFPFVVSEVEGVEDNRVHLSEKHAPYTQRGWNNKRVDDVIDGKWSLKVNGQTGKDKMVIQTIPQNFYFEPGKTYEVSFDYEAGSDDTYAFATGSGDISKNRNFEKTPLKNTVDGGKAKRVTFKVTGDENGQTWIGIYSTKTPNDPRGVKNGNQINFEGTKDFILDNLSIREIHAPKPDATQESGDSAPMNETDERNVNSNGTSADHSETTDVNVSATTDDTAVKGEMTTNRTDAPTVTLPEATIVDEGTSNPVTTTPTNTTQAMTNKADEMPQTMNNVPLTGIATDMMQSHAVDSMAATLAATNQVAAPVRQTAGPMQHGMDSASTQHAPVQVDNVTAPLLPDEQFAELPKTGVTTPNTRGPLMAMIVGAVLTAFGFRRQRKEK

SEQ ID NO: 43237 - protein, 1403 aa, Staphylococcus pseudintermedius
  strain HKU10-03
MLGVHTSDASAAEQDQTSEAKQNLFDASAIFGALTETNEKVAQVTPTEKNLSSVEEMRDKSTTGNGPSITSPQTVEQNNAVQPTATPINDTENSTEAPMKEQSNDAQTTDESNNATQKNNTEPQANNEISARNAKTTAYLTSETFTTATSTTDMPTQKQEYPSLENSTNQSQTNRAQPPTMEAPKLAEGLDNLLKKSTFESMYVTTRNQFDKETVSKTKAWPSDVVPENQVEILADAIQNGYIKSVNDVTNKAHTLSGRAWMLDHGTPTTIANGLTPVPEGTKVYLRWIDQDGATSPIYIAKTTSRLSAADGNQVGPGAYAFDLRTGWIDAKGKHHVYRAVKGQYYKIWINDFRTKDGNIATMLRVAGGYVPGTYVDSVTYNNMGQFPLIGTNMQRTGIFMTTIPSEQYLISKHYVKDTKGAAANPAVTIIENNFVSGKVWIETGAGDYVNSATGPNHNAKDVVASGYKVVMSSLTDQGAKAYDAQVNRLPKKDRAEAARQLLIKHPEYIAATVEGITNEWGRYTLRFPKGTFNKDHLYGYVLDFDGEIVKTYSSFTSPEFRKPNYNLTVTPQTAPYYRPIRRAWVNVNFAVIEAPQSQIEIKEFDATSNPAHRGQTATIDIIGMPKTSLLTRVQWKDSSGSIVEDSGPVFTEEEAEHIAEFVIPSSAKSGEVYTVQLVVGNHIVASDSLIVHVNEEAATYHPIYPSTTVESGQRVTIPAPKNMDGKPLLDGTTFEKGHHVPTWALVNGDGSITVKPGEKVAEGEYDIPVIVTYPDGSKNTIFAPVTVEEKQPMASQYEPITTGVSKPFGNPVMPTDVTDSIQVPNYPLEGQQPTVTVDDESQLPDGTTEGYKDIDVTVTYPDGTRDRVKVPVVTEQQLDSDKYDPVATGILKPFGTPTTEEDVIKLVEIPKYPTDLTQPKVTVTVPNTLPDGQTPGKVDVDVTVTYPDGSTDHISVPVWTNKHLDKDKYNPITTGVSKPFGIPVTPTDVTDSIQVPNYPLEGQQLTVTVDDETQLPDGTTEGHKDIDVTVTYPDGTRDHIKVPVVTEKQPDNEKYEPTTNGITKKYGIPTTEDEVIDIVRIPYFPVDGVQPIVTVNDPRLLPNGQKEGQINVPVTVTYPDGTKDLMTVPVITGKQAENEKYDPITLGVTKDYGDPTTANDVKKSIQIPTYPAGGEQPIATADDESQLPDGTVEGKVDIPVTVTYPDGTQDHITVPVFTNQQRDNQKASKAVTKIHGISVTGTDMTDTKKNHNYPAGGEQPKVTVKDDDQLSEGKVDSTVGADNVTTTDDLSSVTAVSHGHQTSVQTTKENQSVHDEEVTIPTVAHVSTIMTGVVKGEQEAMDIVARPHVETTQLPSISAQATVKQLPETGENNEQSGVLLGGFIAFMGSLLLFGRRRKPKKD

SEQ ID NO: 43238 - protein, 828 aa, Staphylococcus pseudintermedius
  strain HKU10-03
MYGVLGNDEAQANEDVTETTGRNSVTTQASEQHLQVEAVPQEGNNVNVSAVKVPTNTATQAQEDVASVSDVKAHADDALQAQESSHTDGVSSEFKQETAYANPQTAETVKPNSEAAHQSEDEDKQKPVSFSRKEDETMLQQQQVEAKNVVSAEEVSQEENTQVMQSPQDVEQHVGGKDISNEVVVDRSDIKGFNSETTIRPHQGQGGRLNYQLKFPSNVKSGDQFTIKLSDNINTHGVSVERTAPRIMAKNTEGATDVIAEGLVLEDGKTIVYTFKDYVNGKQNLTAELSVSYFVSPEKVLTTGTQTFTTMIGNHSTQSNIYVYYDNSHYVDGRISQVNKKEAKFQQIAYINPNGYLNGRGTIAVNGEVVSGTTKDLMQPTVRVYQYKGQGVPPESITIDPNMWEEISITMVRKYDGGYSLNLDTSKNQKYAIYYEGAYDAQAETLLYRTYIQSLNSYYPFSYQKMNGVKFYENSASGSGELKPKPPEQPKPEPEIQADVVDIIEDSHVIDIGWNTAVGEESGANQGAQEEITENHDIEVIEENNLVEMTEDTALEEESGANQGPQEEITENHDIEVIEENNLVEMTEDTALGEESGANQGPQEEITENHDIEVIEENNLVEMTEDTAVGEESGANQGAQEEITENHDIEVIEENNLVEMTEDTALEEESGANQGAQEEITENHDIEVIEENNLVEMTEDTAVGEESGANQGPQEEVTENQPQQEEIMENQEVEKKGDSNLVESTKTPKAEESVSVQPTLEDKNTKNHVNTVVVNTKVSEVKEKNPHHTKALPDTGTTSRSHSMMIPLLLVAGSVVLLRRKKKHSKVN

SEQ ID NO: 43239 - protein, 233 aa, Staphylococcus pseudintermedius
  strain HKU10-03
MKQSTILKVSLAVGILTTGVGIHSQAAAFASEAHAQNVHSEAQQLKDYYSKTYFEYNDVTGYVEGGKLDVVTPQGTAVSVSLLGNDLSKYTDKANEYNHLDLFVVPEGTDRSAETKSIGGITKTNQRSYYDYVKKPNIIINKKYGELTSSMSTNDFSINKEEVSLKELDFKLRKMLMKEYGLYQNGSSNGKIVIKIGDNDKDIMTLELNKKLQEHRMSDTVDVNKIQQITIDL

SEQ ID NO: 43240 - protein, 247 aa, Staphylococcus pseudintermedius
  strain HKU10-03
MKAKKLLATGLALGILTSTASLYTDHEAQAASKQHHQVKTSSIPYSTTIDGATPFVQSYLKLSNENVSNFKQLNQKVKSTLKQDYKISATQIEKSKTAQYTVTWKNGKKQTISLKNDAALSAQKLNVKDIQQIDIVVKNQTAKQDVKSVPYTVTIDGQTAYVQSFLNISNKNVTNFYQLNQKVKSALNNEYQLSNKDINRAKTAKYTVTWNNGKKQTINLKSHAQLPGNQISGKDIKNIDIEVVSAK

SEQ ID NO: 43241 - protein, 311 aa, Staphylococcus pseudintermedius
  strain HKU10-03
MLLGIMNTGVSHAASDENQAELKLATHNVYMLSGFLYPNWGQSKRADLISKSKYIQDNDVVIFNEAFYPASANQLFNNLKSSYPYQTAVLGRSTSGWDRTEGHYSSTTFENGGVAIVSKYPIRERIQHIFQHGCGFDNDSNKGFVYTKIEKNGKFVHVIGTHTQSEDTRCSVGQDRAIRAEQMKEISNFVKSKNIPKDEVVYIGGDMNVNKNAGNGEFQDMLKNLNVSDVTYTGHSSTWDPQSNSIAKYNYPNSAPEYLDYIFVDKDHRQPGQLINEAVAEKSPTWDVYKFPYLYVYNDYSDHYPVKAYSK

SEQ ID NO: 43242 - protein, 310 aa, Staphylococcus pseudintermedius; identical to SEQ ID NO: 43205
  strain HKU10-03

SEQ ID NO: 43243 - protein, 326 aa, Staphylococcus pseudintermedius; identical to SEQ ID NO: 43218
  strain HKU10-03

SEQ ID NO: 43244 - protein, 434 aa, Staphylococcus pseudintermedius; identical to SEQ ID NO: 43223
  strain HKU10-03

SEQ ID NO: 43245 - protein, 755 aa, Staphylococcus saprophyticus
  MOD_RES (245)..(245): Any amino acid
  MOD_RES (357)..(357): Any amino acid
  MOD_RES (361)..(361): Any amino acid
  MOD_RES (387)..(388): Any amino acid
  MOD_RES (391)..(391): Any amino acid
  MOD_RES (431)..(431): Any amino acid
  MOD_RES (464)..(464): Any amino acid
  MOD_RES (540)..(540): Any amino acid
  MOD_RES (709)..(709): Any amino acid
MKNRENRYSIRKFSVGASSILVATLLFMGGGGGAAQATETHQKVGTSESTLAQSTGDNQKQADEQKTQQNKVQSNEQTTSTSQSVTNENEKQQNLLNENTPSTSVNDDTNKSYTNEETTNRLTDQNTKNQSTEATEASTTETHSDDSQSALTREDPPSLEKQETTKSTLQKDTETSNKKDNTTETTANVNPTAEKATNQELSVTPTTTDESKTLSTKDNTSKITDNHSSEKIRSEPTEETLQSTXSKAEDNSNVNHDSTKNDNNDVETLSTEKNNGIINTNAAKQTIPTKQSIDSTTSKENTLNIKKGTISINDTANETVGNKGAKDQKDSPAELEMLANNTVATTNNTSQQQGTTXTKDXTNKPAKQGQYKNQDPIILVHGFNGFXXGIXPSILSHYWGGDKLNIRQDLEQNGYNAYEASISAFGSNYDXAVELYSYIKGGTVDYGAAHAERYGHERYGKTYXGVYKDWQPGQKVHLVGHSMGGQTVRQLEELLRNGSQEEIEYQKAHGGDISPLLQGGQDNMVSSITTLGTPHNGTHXSDKLGNEAIVRQIAFDLGKKLGNKYSRVDFGLSQWGLKQQPGESYLSYLSRAKTSKLWQTKDNGFYDLTRDGATDLNRKTSLNPNIVYKTYTGEATHSTLSGKYKADYNLFLPFTATANVIGKAPEKEWRENDGLVSVISSQHPFNQAYTEATDVNQKGVWQVTPTKHXWDHVDFVGQDSKDTKRTREELQQFWYDLADDLVQSERSLKLKKLSL

SEQ ID NO: 43246 - protein, 1893 aa, Staphylococcus saprophyticus
MNFKGVKLLKNSKKRLDFLPNTLNKYSIRKFTVGTASILVGATLFLGVSNEAEAAEKIDSPTKEKVATTEEAATKEEAATTEEPATKEEAATTEEPATKEEAAIAEEPATKEEAATTEEPATKEEAAIAEEPATKEEAATTEEPATKEEAATTEEPATKEEAAIAEEPATKEEAATTEEPATKEEAAIAEEPATKEEAVTSEEAATKEKAAIAEEPATKEEAAIAEEPETKEEAATTEEPATKEEAAIAEEAATKEKAVTSEEAATKEKAAIAEEAATKEKAAIAEEPETKEEAATTEEPETKEEAAIAEEPATKEKAVTSEEAHGINNKNKQLLDMDKNSTIDEKFDYAKQAINELNINQKDISNIEASIKNNSDLKNLSKEELNNEILRAALVNESNNNDYGLQTLSAIEPLTTNVRNKNNSLSPVSRLKMLATATSGQNVNDKINITNASLTLNQKNNQHDDNTVWPTSNEQLRLSADYELDNSIKEGDTFTIKYGDYIRPGALELPAKNTQLRSKEGSIVANGVYDENTTTTTYTFTNYVDQYQNITGSFNLLATPKRETVTTDKQTYPMNVTIANQEVSENFVVDYGNHEDHLTNAAVVNVDNVNNQHNEVVYLNQSGDRIYDAKYFSIVQNGTFIPNEVKVYEVLDDNVLVDSFNPDLNGPAVKDVTSEFTPQYSLNNTRVDIDLNRSNMNKGSRYIITQAVKPSGTGNVNTTYELTRYGNEASRYPTGTKSTTVSYINGSSTAQGDNPTYNLGDYVWLDKNKDGIQNDDEKGISGVYVILKDSNNKELQRATTDDTGRYQFNNLQNGTYNVEFVIPNNYTPSPSNTIDNDTIDSDGQKDGDSNVVVAKGTINNADNMTVDTGFYETPKYSLGDYVWKDTNKDGVQDSDEKGIQGVTVTLKDKNGNVLKTTTTDENGSYRFDNLDSGDYIVHFEKPEGLTQTTTNSDSDENKDADGEEVHVTITDHDDFSIDNGYFDEDSDADADSDADADSDADADADADSDADADADADSDADSDADADADSDADADADADADSDSDADADADADADSDADADADSDADADADADSDADADADSDADSDADADADSDADADADADADSDADADSDADADADADADSDADADADADSDADADSDSDADADADADSDADADADADSDADADADSDADADADSDADADADSDADSDADADADSDADADADADADSDADADADSDADADADADADSDADSDADSDADSDADADADSDADADADADADSDADADSDADADSDADADADADADSDADADSDADADSDADADSDADADADADSDADADADADSDADADADSDSDADADADADSDADADADADSDADADSDADADSDADADADADSDADADSDADADADADSDADADADSDADADADADSDADADSDADADADADADSDADADADADSDADADADADADADSDADADADSDADADADSDADSDADADADSDADADADADSDADADSDADADSDADADSDADADADADSDADADSDADADSDADADADADSDADADSDADADADSDADADADSDADADSDADADADADADSDADADSDADSDADADADSDSDADADADADSDADADADADSDADADSDADADADSDSDADADADADSDADADSDADADADADSDADADADSDADADADSDADADADSDADSDADADADSDADADADADSDADADSDADADADADSDADADSDADADADADSDADADSDADADSDADADSDADADSDADADSDADADADADSDADADSDADADADADSDADADADSDADADADSDADADADSDADADADSDADADADSDADKYHNDTADKSNDNELPDTGNNTQNNGTLFGSLFAALGGLFLVGSRRKNKNNEEK

SEQ ID NO: 43247 - protein, 327 aa, Staphylococcus saprophyticus
  subsp. saprophyticus
  strain ATCC 15305 / DSM 20229
MRKKIIATVIGTSALAAVTWTNADAATTYKVKSGDSLWSIANKYNMSVAKLKSLNNLTSNVIFPNQSLKVSGSTSSSTSSNTSTGSTYTVKSGDTLSGIAAKYGTTYQKIMSLNGLSNFNIYPGQKLKVSGAASSSSSNTSGNTSSGSTTTYTVKSGDSLSAIAAKYGTTYQKIMSLNGLTNFNIYPGQKLKVSGKASTGGSGSSSTGSAGYKTPVFNHSNLYDWGQCTWHVFNKRAQIGKGISTYWWNANNWDTAAAADGYTIDRKATVGSILQSDMGYYGHVAFVESVNANGSITISEMNYSASPGIVTYRTIPASQVSSYVYIH

SEQ ID NO: 43248 - protein, 646 aa, Staphylococcus saprophyticus
  subsp. saprophyticus
  strain ATCC 15305 / DSM 20229
MKLHKKKLTLFAFFILTVLTVTLKTYFSYYVDFSLGVKGLVQNLILLMNPYSLIALVLSIFLFFKGKKAFWFIFIGGFILTFLLYANVVYFRFFSDFLTFSTLNQAGNVESMGGAVTASFKWYDFVYFIDTIIYLFVLIFKQKWLDKRVFSKKFVPVVMAASIALFFLNLAFAESDRPELLTRTFDHKYLVKYLGPYNFTVYDGVKTIQNNQQKALANEDDLTKVLNYTKQKQTEPNKEYFGAAKKKNIIKIHLESFQTFLINKKVNGEEVTPFLNKLSTGNEGYRYYPNFYHQTGQGKTSDSEFTMDNSLFGLPQGSAYSLKGDNTYQSLPAILDQQQGYTSSVMHGDYKTFWNRDQVYKHFGIDKFYDATYYDMSEDNIENLGLKDKEFFKESADYLAKEKQPFYNHLITLTNHYPFTVSPEDASIEKPNTGDSTVDGYIQTARYLDESLEEFVNELKKKGLYDDSVIMIYGDHYGISENHNKAMEKLLGEDITPAKFNDLNRTGFWLKIPGKEGTVDKTYAGQADVMPTILHLMGIDTKNYLMMGTDLLSKDHNDTVPFRNGDFVTKDYKYVNGRIYDNKNNEPMTEKPKDFEKRKQQSEKDLQMSDDVLNGDLLRFYDNPDFDKIKPSEYEYKTGPKGQERK

SEQ ID NO: 43249 - protein, 434 aa, Staphylococcus saprophyticus
  subsp. saprophyticus
  strain ATCC 15305 / DSM 20229
MPIITDVYAREVLDSRGNPTVEVEVLTESGAFGRALVPSGASTGEHEAVELRDGDKSRYLGKGVTKAVDNVNEIIAPELIEGEFSVLEQVSIDKMMIQLDGTENKGKLGANAILGVSIAVARAAADLLGQPLYKYLGGFNGKQLPVPMMNIVNGGSHSDAPIAFQEFMVLPVGAESFKESLRWGAEIFHNLKSILKNRGLETAVGDEGGFAPKFEGTEDAVETILEAIKAVGLEPGKDVFLGFDCASSEFFEDGVYNYAKFEGENGAKRSAEEQVDYLEELVNKYPIITIEDGMDENDWDGWKVLTDRIGDKVQLVGDDLFVTNTVKLSEGIEKGIGNSILIKVNQIGTLTETFDAIEMAQKAGYTAVVSHRSGETEDTTISDIAVATNAGQIKTGSLSRTDRIAKYNQLLRIEDELYETGKFDGLKSFYNLSK

SEQ ID NO: 43250 - protein, 291 aa, Staphylococcus saprophyticus
  subsp. saprophyticus
  strain ATCC 15305 / DSM 20229
MKKFNDWLEKHNLRNIPTLIVVVAFVLFVFMTIAFLNHNDEDSSTIYITEDAELRTGPSAAYPEIHSIDKGQNFHKIGKTGKWIEVVSSNNKEKGWVAGWHTNLNIQADKNPNAKPLKDKTIVLDPGHGGSDQGASSNTHKKSKEKVYTLKTAKELKALLEKEGATVSMTRESDTYVTLDDRNIKGDAYISIHNDSLKSSKANGSTVYWFKDNQKALAETLSASLQKKALLTNKGARQENFQVLRQTNVPAVLLELGYISNPTDEDMITEKLHRHIVEQAIVEGLRAYFSE

SEQ ID NO: 43251 - protein, 238 aa, Staphylococcus saprophyticus
  subsp. saprophyticus
  strain ATCC 15305 / DSM 20229
MKKTVVASTLAVGLGVTGFAAGNSADASEQGVDKAQLAQQAQSNPESLNEAPVQDGAYNINFNYNNTDYSFQSDGQYWTWSYGQGSTNAPAQETAEQPQQVEQPQQTEQASTEQPAEEAAPQTEETQQPQQEATTQTTSSSNESTSNESSSSEASEGSSVNVNSHLQAIAQRESGGDLKAVNPSSGAAGKYQFLQSTWDSVAPSEYQGVSPTEAPEAVQDAAAVKLYNTAGASQWVTA

SEQ ID NO: 43252 - protein, 243 aa, Staphylococcus saprophyticus
  subsp. saprophyticus
  strain ATCC 15305 / DSM 20229
MKKTILASSLAVALGVTGYAATADHNQAHASEENIDQAHLADLAQNNPEQLNEKPLHAGAYNYDFVLGGNEYTFTSDGQTWSWNYTTAGAQSASSNTIQDVTAQATTHTNETSANEVRTQQQSSNTEVAAVEAPKASSNTNVQTAQTSTSTKSTTTTTTTSTSSIDAIANQMAERTGVSASQWKGVIQRESGGNANAVNASSGAYGLFQLLGHGEHAGMSVQDQMDKAVEVYNNQGAGAWVAW

SEQ ID NO: 43253 - protein, 317 aa, Staphylococcus saprophyticus
  subsp. saprophyticus
  strain ATCC 15305 / DSM 20229
MKRLLFFVIMVMFVLAGCGTENDEAKSADKDSDKSKATSKMKKFKIGQAVDADGVQVKLTKIEYVNDYDEYSAPENGKVIKVYLKFKNNNEDQVLMDSSDFSMKVNNENYQEWFGNDDTNAGFSHQLNKGNTGSGYITYDVPDSDNYTLEMDATPKFNNVKAKWEIKKTDIKEASVANSNESNDEAETDTNVESEDSEEPKITDEDSEDTESEETGYSAEMYNALVDEYNALTDGEKMNHVDDDVLEIEYDQLEARVDALYDKKMDEEDKALEEEMEQDEKEYEEEMEAIDKEYEEEMKKIEEEDTTDEDTSEDDAA

SEQ ID NO: 43254 - protein, 2316 aa, Staphylococcus saprophyticus
  subsp. saprophyticus
  strain ATCC 15305 / DSM 20229
MNKNKKRHRFDFLPNRLNKYSIRKFTNGIASVLIGSTILLGAVIDKEADAAEQQPTSEVYGQTDNNYKSESNKSNSVQHDEERTNIINDNDEANYSNHSEIPIHDKSSEYDQKPINEQDTSNHHETHLNQNATENHVKEESKEVSTEEESIEDRKTEESTTEESKAVEEANKENTTEKNDEGSLDLEKEKDTYKDEKDNGKKKNELESHNHRIENKVEDNVYKNNKETNLESKNENVNKDDKVNTSSSTSIEKPEDNATRSNLINSVNHSLKQLDNAKNNTEKQSLLENYYQTHTNATASDAKKAIEKLNIDFTKQNSDQLIALLLIELANQMDKDKVQANVPASKRAETNNESLSIETNTTNIEKTLAKPSTSKFRSANTRATNVVNYAANQSGRNVNHLVFANTSYEILGGGKKYNQVFMTMDGKLKIKIDYTVDDSVVEGDYFTVDFGKYIHPGTSRKPYRVNNIHDANGRTIAIGSYDSATNTAKYTFTNYVDIYNNVRGSFSLLSWPFKELVTTDKQSVPVGITVAGEDYTQNVIFNYGNRTVPVISDINYLTKDFAEFTTYINQNRAFNTGSKVRLSGQGFKFTSPDEIEVYKVLNNSQFRDSFSPDYANLTQVRNPKIIINSDGSATVDLGDIGTLGYIIRSKPNTLPDFSGIGVLKSEYTFTNNKNQRDTRAHASSIQFVRAELAGFGGFGGYVWFDKNNDGVQNDSNAAAAGITVNLLDPTGIRLATTTTDITGHYNFDNLTNGNYLVEFVMPEGYIPTQANSTVDDKDSDVVFENGRYIAHVTIKDADNMTIDAGLVSDTTSESLSLSESLSTSQSLSLSHSLSLSESESTSQSLSLSTSESLSQSLSLSASESLSESESLSESESLSESESLSASESLSESESLSESESLSASESLSTSESLSASESLSESESLSESESLSESESLSESESLSTSESLSASESLSESESLSESESLSASESLSDSESLSASESLSASESLSASESLSASESLSASESLSESESLSDSESLSESESLSESESLSTSESLSASESISASESLSTSESLSTSESLSESESLSESESLSEYESLSASESLSASESLSTSESLSESASLSESESLSTSESLSASESISASESLSASESLSESESLSTSESLSTSESLSESESLSESESLSSSESLSSSESLSESESLSTSESISESESLSTSESLSASESLSESESLSASESISESESLSASESLSEYESLSTSESLSSSESLSESESLSASESLSESESLSASESISESESLSESESLSTSESLSASESLSESESLSESESLSESESLSESESLSASESLSESESLSESESLSARESLSQSEALSESESLSTSESLSESESLSASESISESEYLSESESLSASESLSESESISASESLSESESLSESESLSESESLSTSESLSASESLSESESLSESESLSESESLSESESLSESESLSDSESLSESESLSESESLSESESLSDSESLSESESLSESESLSESESLSESESLSESELLSESESLSESESISESESISASESLSESESLSESESLSESESLSESESLSESESLSESESLSESESLSASESISASESLSESESLSESESLSESESLSESESLSTSESLSESESLSTSESISESESLSESESLSESESLSESESLSKSESLSESESLSESESLSTSESLSESESLSASESISESESLSESESLSESESLSTSESLRQSESLSQSLSLSASESLSASESISESESLSESESLSASESLSESESLSASESLSESESLSESESLSGSESLSASESLSESESLSESESLSESESLSESESLSGSESLSASESISESESISASESLSESESISASESISESESLSTSESLSTSESLSESESLSASESLSESESLSESESLSESESLSESESLSASESLSASESLSESESLSESESLSESESLSESESLSESESISESESLSESESLSESESLSESESISDSESISESESLSESESLSESESISESESLSESESLSESESLSESESISDSESLSESESLSESESLSESESLSESESLSESESLSASESLSASESLSASESLSESESLSDSESLSESESLSESESLSASESLSASESLSESESLSESESISDSESLSTSESLSESESLSESESLSGSESLSASESLSASESLSASESLSASESISESESLSESESLSESESLSDSESLSESESLSTSESLSASESLSESESLNTSESMSESESLGASESISEYESLNRHLNNDGNYEKEKDKLPDTGNEDKHNGLIPLLTALGGIILLRRRRNNEIQDK

SEQ ID NO: 43255 - protein, 249 aa, Staphylococcus saprophyticus
  subsp. saprophyticus
  strain ATCC 15305 / DSM 20229
MKKTVIASTLAVGLGVTGIAAGNSADASEQGVDKAQLAQQAQSNPESLNAAPIQDGAYNINFNYNNTDYSFQSDGENFSWSYGEGSGEGSNASSEQATDNSSQQTAEQPQQVEQPQQTEQASTEQPAQEAAPQTEATQQPQQEATTQSASSSNESSSNESSSSEASESSSSGVNAHLQQIAQRESGGDIHATNPSSGASGKFQFLQSTWDSVAPAEYQGQPAASAPESVQDAAAQKLYDTEGASQWVTA

SEQ ID NO: 43256 - protein, 238 aa, Staphylococcus saprophyticus
  subsp. saprophyticus
  strain ATCC 15305 / DSM 20229
MKKTVVASTLAVGLGVTGFAAGNSADASEQGVDKAQLAQQAQSNPESLNAAPVQDGAYDINFNYNNTDYSFQSDGQYWTWSYGQGSTNAPAQETAEQPQLVEQPQQTEQASTEQPAQEAAPQTEETQQPQQEATTQTTSSSNESTSNESSSSEASEGSSVNVNSHLQAIAQRESGGDLKAVNPSSGAAGKYQFLQSTWDSVAPSEYQGVSPTEAPEAVQDAAAVKLYNTAGASQWVTA

SEQ ID NO: 43257 - protein, 1228 aa, Staphylococcus saprophyticus
  subsp. saprophyticus KACC 16562
MPNRLNKYSIRKFTNGIASVLIGSTILLGAVIDKEADAAEQQPTSEVYGQTDNNYKSESNKSNSVQHDEERTNIINDNDEANYSNHSEIPIHDKSSEYDQKPINEQDTSNHHETHLNQNATENHVKEESKEVSTEEESIEDRKTEESTTEESTTEESTTEESKAVEEANKENTTEKNDEGSLDLEKEKDTYKDEKDNGKKKNELESHNHRIENKVEDNVYKNNKETNLESKNENVNKDDKVNTSSSTSIEKPEDNATRSNLINSVNHSLKQLDNAKNNTEKQSLLENYYQTHTNATASDAKKAIEKLNIDFTKQNSDQLIALLLIELANQMDKDKVQANVPASKRAETNNESLSIETNTTNIEKTLAKPSTSKFRSANTRATNVVNYAANQSGRNVNHLVFANTSYEILGGGKKYNQVFMTMDGKLKIKIDYTVDDSVVEGDYFTVDFGKYIHPGTSRKPYRVNNIHDANGRTIAIGSYDSATNTAKYTFTNYVDIYNNVRGSFSLLSWPFKELVTTDEQSVPVGITVAGEDYTQNVIFNYGNRTVPVISDINYLTKDFAEFTTYINQNRAFNTGSKVRLSGQGFKFTSPDEIEVYKVLNNSQFRDSFSPDYANLTQVRNPKIIINSDGSATVDLGDIGTLGYIIRSKPNTLPDFSGIGVLKSEYTFTNNKNQRDTRAHASSIQFVRAELAGFGGFGGYVWFDKNNDGVQNDSNATAAGITVNLLDPTGIRLATTTTDITGHYNFDNLTNGNYLVEFVMPEGYIPTQANNTVDDKDSDVVFENGRYIAHVTIKDADNMTIDAGLVSDTTSESLSLSESLSTSQSLSLSHSLSLSESESTSQSLSLSTSESLSQSLSLSASESLSASESLRESESLSDSESLSESESLSTSESLSESESLSASESLSEYESISASESISASESLSESESLSTSESLSASESISASESLSESESLSTSESLSTSESLSESESLSESESLSTSESLSESESLSTSESLSESESLSESESLSTSESLSESESLSASESLSEYESISASESISASESLSESESLSTSESLSASESLSASESLSESESLSESESLSESESLSESESLSESESLSESESLSESESLSESESISDSESLSESESLSESESLSASESLSESESLSESESLSASESISDSESLSASESISESESLSASESLSESESLSTSESLSESESLSTSESLSESESLSESESLSTSESLSTSSR

SEQ ID NO: 43258 - protein, 92 aa, Staphylococcus saprophyticus
  subsp. saprophyticus KACC 16562
MSSSSSEASEGSSVNVNSHLQAIAQRESGGDLKAVNPSSGAAGKYQFLQSTWDSVAPSEYQGVSPTEAPEAVQDAAAQELYDTEGASQWVTA

SEQ ID NO: 43259 - protein, 249 aa, Staphylococcus saprophyticus
  subsp. saprophyticus KACC 16562
MKKTVIASTLAVGLGVTGIAAGNSADASEQGVDKAQLAQQAQSNPESLNAAPIQDGAYNINFNYNNTDYSFQSDGENFSWSYGEGSGEGSNASSEQATDNSSQQTAEQPQQVEQPQQTEQASTEQPAQEAAPQTEETQQPQQEATTQSASSSNESSSNESISSEASESSSSGVNAHLQQIAQRESGGDIHATNPSSGASGKFQFLQSTWDSVAPAEYQGQPAASAPESVQDAAAQKLYDTEGASQWVTA

SEQ ID NO: 43260 - protein, 308 aa, Staphylococcus saprophyticus
  subsp. saprophyticus KACC 16562
MVMFVLAGCGTENDEAKSADKDSDKSKATSKMKKFKIGQAVDADGVQVKLTKIEYVNDYDEYSAPENGKVIKVYLKFKNNNEDQVLMDSSDFSMKVNNENYQEWFGNDDTNAGFSHQLNKGNTGSGYITYDVPDSDNYTLEMDATPKFNNVKAKWEIKKTDIKEASVANSNESNDEAETDTNVESEDSEEPKITDEDSEDTESEETGYSAEMYNALVDEYNALTDGEKMNHVDDDVLEIEYDQLEARVDALYDKKMDEEDKALEEEMEQDEKEYEEEMEAIDKEYEEEMKKIEEEDTTDEDTSEDDAA

SEQ ID NO: 43261 - protein, 248 aa, Staphylococcus saprophyticus
  subsp. saprophyticus KACC 16562
MKKTVVASTLAVGLGVTGFAAGNSVDASEQGVDNAQLAQQAQTNPESLNEAPVQDGAYNINFNYNNTDYSFQSDGQYWTWSYGQGSTNAPAQETAEQPQQVEQPQQTEQASTEQPAQEAAPQTEETQQPQQEATTQNTSSSNESTSNESSSSEASEGSSVNVNSHLQAIAQRESGGDLKAVNPSSGAAGKYQFLQSTWDSVAPSEYQGVSPTEAPEAVQDAAAQNFMIQKALHNGLLHKKLSVVMNLR

SEQ ID NO: 43262 - protein, 261 aa, Staphylococcus saprophyticus
  subsp. saprophyticus KACC 16562
MAIAFLNHNDEDSSTIYITEDAELRTGPSAAYPEIHSIDKGQNFHKIGKTGKWIEVVSSNNKEKGWVAGWHTNLNIQADKNPNAKPLKDKTIVLDPGHGGSDQGASSNTHKKSKEKVYTLKTAKELRALLEKEGATVSMTRESDTYVTLDDRNIKGDAYISIHNDSLKSSTANGSTVYWFKDNQKALAETLSASLQKKALLTNKGARQENFQVLRQTNVPAVLLELGYISNPTDEDMITEKLHRHIVEQAIVEGLRAYFSE

SEQ ID NO: 43263 - protein, 753 aa, Staphylococcus saprophyticus
  subsp. saprophyticus KACC 16562
MKNRENRYSIRKFSVGASSILVATLLFMGGGGGAAQATETHQKVGTSESTLAQSTGDNQKQADEQETQQNKVQSNEQTASTSQSVTNENEKQQNLHNENTPSTSVNDDTNKSYTNEETTNRLTDQTTKNQSTEATEASTTETHSDNSQSALTREDSPSLEKQETTKSTLQKDTETSDKKDNTTETTTNVNPTAEKATNQELSITPTTTDESKTLSTKDNTSKITDNHSSEKIQSEPTEETLQSTSSKAEDNSNVNHDSTKNDNNDVETLSTEKNNGIINTNAAKQTIPTKQSIDSTTSKENTLNIKKGTISINDAANETVGNKGAKDQKDSPAELEMLANNTVATTNNTSQQQGTTETKDQTNKPAKQGQYKNQDPIILVHGFNGFTDDINPSILSHYWGGDKLNIRQDLEQNGYNAYEASISAFGSNYDRAVELYSYIKGGTVDYGAAHAERYGHERYGKTYEGVYKDWQPGQKVHLVGHSMGGQTVRQLEELLRNGSQEEIEYQKAHGGDISPLLQGGQDNMVSSITTLGTPHNGTHASDKLGNEAIVRQIAFDLGKKLGNKYSRVDFGLSQWGLKQQPGESYLSYLSRAKTSKLWQTKDNAFYDLTRDGATDLNRKTSLNPNIVYKTYTGEATHSTLSGKYKADYNLFLPFTATANVIGKATEKEWRENDGLVSVISSQHPFNQAYTEATDTNQKGIWQVTSTKHNWDHVDFVGQDSKDTKRTREELQQFWYDLADDLVQSETLTQTQKA

SEQ ID NO: 43264 - protein, 58 aa, Staphylococcus saprophyticus
  subsp. saprophyticus KACC 16562
MDKRQNKYSIRKFTFGASSILIGSLLFLGVGTAQATEEDHHTETKVQQLSGNQLGNDK

SEQ ID NO: 43265 - protein, 329 aa, Staphylococcus schleiferi
MKKLPLAKKFTSVILANLFLLGLSIQSTAHAAKPVDNNELKLVTHNVYMLPKSLYPNWGQSIRADLISQSFYIKGNDVVILNEAFDNSASNQLLNNLKNEYPHQTGVLGRSRSGWDSTEGSYSSTVLEDGGVAVVSKYPIKERIQHVFRRGCGFDNDSNKGFVYTKIEKDGKNFHVIGTHTQAEDSRCGAGYDREIRAEQMREISTFVKNKNIPKDEVVYIGGDLNVNKNSTSGEFQDMLKNLNVNDVTYKGHTSTWDPETNYIAQYNFPNAKPEYLDYIFVDKDHRQPGQLINEAIDAKAPSWHVYAFPYTYYYNDFSDHYPVSAYSR

SEQ ID NO: 43266 - protein, 205 aa, Staphylococcus simiae CCM 7213
MKKVSLLATTTLAGALLFTGLESGHEAKAAEINANQAKNAAVNISKGYTEAGKVSFNKDYTDEGNFYRFQFYGEEDNGVGFIDVYKDGNTIKYSTPRSGPDGEKVVHGDFLNGQNANTATSNNQQVPSNNAQNQTPAPNNNAQNQTQNQNNMQQPTNVEQAPATHMTELPATGEQASNSTFIAVIASALMAVGSVLTFKRFSKNK

SEQ ID NO: 43267 - protein, 2320 aa, Staphylococcus simiae CCM 7213
MNLFREQKFSIRKFNVGIFSTLIATVTFITANTSHASAAEQPSNANQLDNTVTVQPVNGTQAGNVTSPNTVQSSTATTAQSLNNNGNNAVSNGGNQVAQTNKNDNAVNTTTGQNDTQNLRLAAQGDHDKVLKRRKRDVGANPAAPNNAAPAAPNNAASPAPNAVAPTAPAAPVPPKVQQQDPNENNTGQGSINTVLTFDDPSIVTDKDRNNPTVTIKDNVDGYTLVDHGKVGFVNSNLRRSDMFDKHSPQNYQASGNVLVLGRVKADNNNDHGDFNGISKEVNVKPGSELVVDFTTMQTNSKQGSTNFVIKDAKNDTELAKVNVGTRGVSHLFKVPVDVDHLALQFLPDNAAVADATRITTNKDGYKYYSFIDNVGLHSGSHLYVKQRELNPTATNQKDYVINAEIGNNGNYGASLKDGQFVYSVTLPQGVSYVANSLSTSFPVGNNDSTKLLPMAEQYDKTTNTVTFTSKGVRTENNTHTKEVLFPEKSLKLTYKVNIDNVPTPQQIHFNDKLTYQTAADVLMNAANSPVVTLVTDPYTTDVVMNKEALQAQVDQAIDANQYTAGSIAEYNKLKEQATQVLNEEQNNVPLDQRKSQAAIDQLVQELKDKLVEKQPAITELDNKAQQMITTNSQNNQLTQEEIADITTKINNDKQAAINQIDQQTTAAGVTTAKDAGLNALAADVAVPTVKQAAKNAIIKAVAKRKQEIKKLTAPVQEEKDVANATIGNIEVNALTTLNSTNTNEAVETLKDNTINNINNVVPDSYVRTNAIDAINEAATNQQEVVNNSKESTDSEKAIAIAEIDKAKEAALKAIETPTTRQDVNNTKDAELAKIKAITAATTIKTNAKTAVEQAATQQIQSNNNATAQNATTDEITAANEEVEQAKQAALDAITEAQTDQEVETAKNNGIQAINSSTPDINAKQNAKTAVDEAYTTHKQEITDNQNATTEEKAAAITDLDNKKQQADTNIDQAQSNAEVETAKTNGINEINQVQPATQYKAAAKTAVEQAATQKNNDIDQDNAATTDEKDAAKAKVQQAVTEANEAIEQAAAQADVDNAKTTHIQNINNVQAEHQVKTNAKADIDQKVQEQQTAIQNNNAATTEEKAAAEQQLQAAKTAADNAIDAAQSNQDVDNVKAAEIAKITAIQPATTIKSTAKQAIQTKAEERKAQIAATADITAEERDAADQQVDAAVQQADTAIDNAASQTDVETAKTNGENAIAQVQPTVTKKNDARTALDNQANTKKQQIQGLADATTEEKTAGEALVDGEVTKGKAAIDQATTNAQVDTAQQSATDAINNLQPQVRKKRDALAEITQQQNSQTAEINNNADATTEEKEAALQQLQQAVTKANNDINAATTDADVDTAKTTGLADISAVQPATTTKTAAKNDLAQAATARQQTIEADNSATTEEKAAATELINQAKEQGDLAIQNAATAQEVSAAKDEAINNINGINADTTIKDYAKTEINNRVNRKRVEIQNDSNATTEEKATATQQLDGQQATIIQSITNANSVEEVNAAKDKGLQDLDNINAAHDIKTAAKDEIKQTLVNKADQISKTADITTEEANEAASRASQIYVDGINKINAANSTQEVNAAKDAINQEINAVQPTVTKKATAKNSLDTVANNKKADLDQTPNASAADIANAKQQVIDLLNGAKEKINQAQANADVDAIVADATNQIQAVKTLSTIKADAIADIENAYNQKVADIEAAINSTASEVNQAKQQLDNLKQQDIQKINQATTAEDVATQKDEGITNINGFEPQFTKKQTATDDLYHAADQKNDQILENDHATQEEKQQAANDVEAIVQDTLEKINNAADDSDVDEALSQGKAAIAAIQLATINKVDATKAIDTKADEIKAEINDNDALTDEEKASSLALVKQYSDDALAKINAATTDDAVDKAKQDGLVALDNIQVEDTHKQQAIDELESLLDQLEATANNNDNATTDEKEAYTNALEGILSTATDNINAQTTNAGVDKVKDEAKAEITKQNFDYHAKQNATNEVNKAIERQKEDIKNTPNVSEQSKQTALQDLARSGERFTKDLAKAKTDAEVTELQNATIHSIEAIIPFDETNNGTQPNNNTNPTPNDNGAVAPDNNGNAQPNNNDVASTNNTNTTTPDNNGTGQPNNSSVEQPTNTPTNKPTDTTEVKPTDKPDPNAATTPNNSGTEQPSNNETNKPDPKDPEKPGKGPKKPSKDPGKQGKGPKKPGEGPDKSGKDPGKQGKVDTGGNTGNGNGEPGKQGKADDNIGSGDNTTHKTTVTDKTETKDKVKREKKELPKTGVTYTDDLPYAELALGAGMAFLIRRFTKKDEQSEK

SEQ ID NO: 43268 - protein, 120 aa, Staphylococcus simiae CCM 7213
SDSDSDSDSDSDSDSDSDSDSDSDSDSDSDSDSDSDSDSDSDFDSDSDSDSDSDSDSDHHEGTPEHGHHEGYGEPKHEEDKALPETGSEDTANNGTLFGGLLAALGSLFLFGRRKKREDK

SEQ ID NO: 43269 - protein, 434 aa, Staphylococcus simiae CCM 7213
MPIITDVYAREVLDSRGNPTVEVEVLTESGAFGRALVPSGASTGEHEAVELRDGDKSRYLGKGVTKAVENVNDIIAPEIVEGEFSVLDQVSIDKMMIALDGTSNKGKLGANAILGVSIAVARAAADLLGQPLYKYLGGFNGKQLPVPMMNIVNGGSHSDAPIAFQEFMILPVGAKSFKESLRWGAEIFHNLKSILSKRGLETAVGDEGGFAPKFEGTEDAVETIMQAIEAAGYKPGEEVYLGFDCASSEFYEDGVYDYSKFEGEHGAKRSAAEQVDYLEQLVNKYPIISIEDGMDENDWDGWKQLTERIGDRVQLVGDDLFVTNTEILSRGIENGIGNSILIKVNQIGTLTETFDAIEMAQKAGYTAVVSHRSGETEDTTIADIAVATNAGQIKTGSLSRTDRIAKYNQLLRIEDELFETAKFDGIKSFYNLDK

SEQ ID NO: 43270 - protein, 291 aa, Staphylococcus simiae CCM 7213
MTKISTWLANNGLKNKRTLIIVIAFVLFIIFLFLLLNSNDENNGNITVTENAELRTGPNAAYPVIYKVDKGDHFKKIGKSGKWIEVVNTSNDEKGWIAGWHTNLDITEDATKTKNALKGKTVVLDPGHGGSDQGASSTTKYKSLEKEYTLKTAKELKSFLEDEGATVKMTRKDDTYVSLDDRNVKGDVYISIHNDSLESPNANGATVYWFHDNQQQLANTLNSAIQKKALLSNRGARQQNYQVLRQTNIPAVLLELGYISNPTDENMIKDQLHRQIVEKAVIDGLKQYFSA

SEQ ID NO: 43271 - protein, 560 aa, Staphylococcus simiae CCM 7213
MKNKYAIRKLSVAVGSVIIGTTLFVSGEAKADEIKTNDGTVQQNEVAQEPTKETPKTQNENVEQNNNQQTQVETKQENQLPQFITNSEVKTEKDDNGQTPIWSKQQVNYEWNATQYKKGDVINFDLPKEVRLANEQNFDLNTPDNITIGSVNATTNGAVTVNLKDENNYLATHQNTQGWIKFETMFNRDVVKDDQPFEIKVGDKTYKGFIAKNEANKTPLQKFGYIDDDKKIRWDVNVNFDQQTIDNAKVTDTLGEGQTLDEDSVEVYEYDTDTNKATGTYAKDKWKLTPTTNGFVIDFLEQIKSSYQIEYTTMPLRGLNKPYQNSVELTGTGYDTASKTVDSEVSNSDGGGEGNMIPEKPSEPEQPQPEEPSEPKRPDVETPENPEPNEPNEPVQPKPEEPNKPNVPEPNTPEVPDTPEQPDVPKTDEPEQPNNETPETPKSETPKNEIPNKSETPNTPREEIPNKPNTETPYKANKEHLNTPNSINPKELNNAKKEVSVTPQKHVSDKPKQQMKNQKESESKTLPETGQSSTNYTLPILTFIGGLLLTRKLKANKEDK

SEQ ID NO: 43272 - protein, 198 aa, Staphylococcus simiae CCM 7213
MKKISLLTTTTLAGALLFTGIEAGHQAKADTIDTIKIANQQEWQYQHDKLLQGRLSGQSSEGGGVGAVNSYDNSYQEYYDHALKSAKEQGLNVEVRSLDESKEQFKDDPNANFGETDDQQTMNQQTNKQQVQNNTPSSSTVHKAEAQSNIQQTDDTKVMKALPETGDTSSSNSLIAVLASTLMAIGSVLTFKRLSKNK

SEQ ID NO: 43273 - protein, 1352 aa, Staphylococcus simiae CCM 7213
MSNKKKNNVGSRLDFMPNRLNKYSIRKFTVGTASILVGASLILGHQEAEAAETTQSESSPNTDSTNQSTDNTTSNVQSNNTTQATTSDTQNTTTKSPTSNTTASTVNEKVETTNKNDTKLNEDKKITNKDNVNTNNDISTTNNKAESPAQNKGTTEQDTANSSHDQHTDQNQQNDKKVNDSQKAQNKTVKTNQDDTNQQNTSGNNEPAQSTNDTTTKKEQYAANKVADLGVDKNVQTDVAQNVKSQNDISNLSKEQLDQIILATTIQKDLQNPNSKLGLDPFIALAATPASASTSTTPTPVSPKFKTRMFFATPTPSGTNVNDKVNFTNLTMTTTQGRTLNGNPDVWITSADNIIIKGNYQIDNTVKEGDYFTVKYGDYIRPGGGIDYLPGNVDLKSVDGDIVARGDYDKASNTIKYTFTNYVDQYKDIKGSFTSINSAKRENATTDKTVYPMAVTYGNQSVTNNIAVEYGNNKSDVLVSATSYSNNKQYNMVTYVNQPGSIHYNTKLTTDLNGFTLDKNNFKIYEVLDTSAMVDSFTPNYSDTSKLKDVTSSFASAITTNNDNTQATINFGNIAQNKRYIVSQVMTRTGNADSDKISYTLTGLDKNNRPESVKKVNSYSTSSGTSTANGTELTYEIGDYVWEDTNQDGIQNDGGKGIANVYVKLTDATTGTVIDRVTTDANGKYLFKNVPNGTYKIDFTAPSNYTASPVTAGSDTALDSNGQTTTVTVNNANNYTIDSGFFRNDQYKLGDYVWEDTNKNGIQDVNEKGIAGVSVALKDSKGQVIDQTTTDGDGKYLFTNLKNGTYTVTFQPPAGYKATLANQGTNNALDSNGLESTATINFADNNTIDSGFIKKDKYNVGDFVWNDSNKNGIQDAGEAGIGGVTVLLKNDQGRTIANTVTDRDGKYGFYDIEEGTYTIQFIEPDGYTLSPTNVGSNTNIDSNGPVVKLVLQNNDYSNDLGLYKNTAPSLDEYEITVEDVSYKNEVRENKSLPKNTIQLAQQGEDGRDRVFYKQLGYNPDLTGKDQSKLLQVNGYYFEEVRRDHLYTSKNAIFEYNLDDNAGVTNITYNPGNNTYTVTYNDGSTKELPGQQPKGLTIDNSYINNNGDTVVNFSDGSTITIPKGKDGVDGKPGVDGKTPTVEQTPITNDKGEQTGVTIVVKDGNGNVVSTQNVLNGKNGTDGKDGAKGEKGDKGDKGDTGANGKDGTNGVDGKDGKTPTVEQTPIKDAQGNTIGTTIIVKDGDGKEISRQNILNGKDGANGADGKDGKTPTVEQTPIKDAQGNTIGTTIIVKDGDGKEISRQDILNGKDGTDGKDGAKGEKGDKGDKGDTGANGKDGTNGVDGKDGKTPSVEQ

SEQ ID NO: 43274 - protein, 1342 aa, Staphylococcus simiae CCM 7213
MKNKQGFLPNRLNKYAIRKFTVGTASLLIGATLVFGVENVAKADELDNSSTQNKDGSKDKSEPVDITELTDSSATNNKDKATTTSTETTTTVEPNSAGTSNEMTTTNTDDKEGTESAEQDTTSSDKTSKQESSSTNQSTIDNTTDNHATQDTTSTDKTTQNEKDSATNKNETTNDKQATQDTTKTSEQHKASKARDRETTKVDENDNKADVTTDKKASTKGGKVVKSSNTTKAKSDKKVAQNTKTKKDNKATKQQSNKTAKKVASKHDTTSTNNTELAKKLAKSKDKATAVNSFLKEHVSESEAKDILNNTDVNFNKASDEEINQAVLQAALIELANKQQSTETLATAPRVRTFMRAMATPVMFAAAVNDSEDVQKSLGYSSNYTFSSLVFAPGTLDSDAAKANNYIPFDIHAYMSGSNSGSRYKIDLKLDEKIADHVTKITVNPAGRSTPVEFVRLTDDNGNPSDIWEVNYIRANGGLFGGAEILKTYSATNGRIELDDTVGNILNEAGNLSNNKLNYQIYVRDSNNNTIIRTSESGGYFLTSTDSDLAALNNNKSTANSDAFRASSGTAVLDTTVGTNGAIIVDQQIVKSGTFGYGGGQNKQWSYNYQIDKDLIPFIESVELDRYDYNGLSGFDKTYNASNKVADLKIDANGNGTITASDLNNLIEFNNGLPEPVGIRVVIKLNQSPNNILTKDAQYDSNGNLITSTTDRLEDFTFAGYLTDNAGKLINNTLGTTSLGLQDYDQDGLLDSYERDVSLTDPNNADTDGDGKNDGDEVKKYLTSPLVGTPQVADITINDTKVSGSVPLQPNAGSQTAKVINPAGQVIGTSAVNSDGTFTVTIPKSAAGQYTIAIDAANYPNDETSTFNIIDNTIVPAPLIDPVDDNDTTIGVRGTAGSTITVKDNNNNVIGTVTLGANSTTGTLTLTKPLTAGTQLTSTATKNGKTSTVSPTVTVTDATAPDAPVINRVTSEDTTVKGTAEPNSTVTVIFPNGTTQVTTADSSGNYTVNIPSSLDLTGSEVIKATATDAAGNKSVESNTTVVDTTAPNQPTVNRVTSEDTTITGKAEPNSTVTVTFPNGTTVQAITTTDGSYRVAVPTNIDLKGGENLTVTATDKAGNTSTSANTTVVDVTPPAEPTINTVTSQDTTITGKAEPNSTVTITFPDGTTATGTTDQNGNYTVNIPNTIDLKGDEELSAVATDAAGNKSVESGTTVLDKTAPDAPTVNPVTSEDTTITGKSEPFATITVTFPDGTTATGTADEDGNYVVDIPSSVDLKGGETLPVTSTDEAGNVSAPANTVVTDTTAPTAPTVNPVTSEDTTITGKAEPNSTVTVTFPDGTTATG

SEQ ID NO: 43275 - protein, 237 aa, Staphylococcus simiae CCM 7213
MKKTIIASSLAVALGVTGYAATSGHQAHAAETNVDQAHLVDLAHNHPEQLNAAPIQDGAYDIHFVQGGFQYNFTSDGHTWAWSYDVANGQTTSFATTAAQGTTDYSASYNQEATTTQAVSNNAQSSNANVETVSAPSANYTTSTASSSSVRLSNGNTAGAIGSYAARIMAQRTGVPASTWEAIIARESNGQVNAHNPSGASGLFQTMPGWGPTNTVDQQIDAADKAFKAQGLSAWGK

SEQ ID NO: 43276 - protein, 478 aa, Staphylococcus simiae CCM 7213
GQPVTNSVSGLPEGVTFDEATNTISGSPTMVGTYPVTVTTTDAEGNTTETKFTITVVDTTAPTVKAIDDQTKEVNTPIDNIVIDGSDNSGQPVRNSVSGLPAGVTFDSETNTISGSPTTVGTYPVTVTTTDAEGNTTETQFTITVVDTTAPTVKAIDDQTKEVNTPIDNIVIDGQDNGGQPVTNSVSGLPNGVTFDEVTNTISGSPTTVGTYPVTVTTTDAEGNTTTTQFTITVIDTTAPDAPTINPVHKGDTTITGKAEPKSTVTITFPDGTTATGTTDADGNYTIDVPSNVHLNGGDHINAIATDKSGNDSPAADTIVIDDSKPVDPDHPTDPTDPTDPVKPTDPSHPTKPNQPTQPSQPGTVVPPSTPKNDRPSNDHHNNAEPSQQQNTSDNNMTPTQNNHRYSRQERIYNESAKTHHKKGNNKATANKQQSELPETGDSETNKGTLFGSLLAGLGALFLFFKRRKEDEDTDKEQ

SEQ ID NO: 43277 - protein, 879 aa, Staphylococcus simiae CCM 7213
MRDKNKLTQKSFVANRLNKFSIRKYTIGTASILVGTTLLFGLGNQEAQAAETNANNNESATTNTNKNKQDNEVNQSEVEVNNSIDNNETNNDNVQSDKEISSENKVTEKQQDTTNNNINDNTKLDNDSKTSSDNAQVEDSNIVNNQQEETSSPREKVADDKIEHNKQLTSQDEKEQSTEASYQPSKENTNIGTPHVVHNSQVSQPQENTQSTTEEKTNEENMTSQIEPTTVENNQILDANQVASNVTITKEELEKDPSKLNDLIRQYNEKQSSEESQATPATSVAPKRLTPRMRVAAVQAGTDVTNQIDFNKIDIQFDSNEIRPINAESYNLTVSFDTVNAVNPGDYFKFKGSDNTINDDLNHNNTEAPDIVDKEGNIIANGIYNPMTREYKYTFTDYVNNKKNIQGNISLSQYINRDVVRNDSANEKITYTFGDKQVSKNEDVVYDNEYVEKAYSNIGSAYTHYNQDTQDYEQTIYVNPLNKYVPDAIVDIRGYQVKNGDSSAQINNDSQIKIYKLKDGAKLNASYFNDDSDLIDVTDQFDITKNGNKASIYFGDIDEDSYIIKVNSKENDKINKDLIQSVTMSADDGDYYDSVYYYNFIKVTDNTADGSGEDIDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDLDSDSDS

SEQ ID NO: 43278 - protein, 965 aa, Staphylococcus simiae CCM 7213
MNKRIDFLSNKQNKYSIRRFTVGTTSVIVGITILFGLGNHQANAAETTDATTESFSDNANKDSEKSTSQRDNNILTTTNDNNVNQQSSDLDLKNDVNVEQRSTPNDQHNNASTLINGIEDKAPSNRVSTTDETKPKVTSIPQQTTPQNSDTTNNQQSQSNSQDTLATNNQDAINNIHLVKAEMNTPSIESNQSQTMNNGTREPIKATKPRTMIRSLATSPRFNVLAADVAGTNVNDQVTASNFNLATHTFDPNQSGNTFMNADFKVNGEVKAGDYFTMQLPSSLTGNGDVDYSNVNNTMPIKDITNAAGDVVATATYDTVSKTYKFVFTDFVNNKTNVKGNLGLPLFTDRQNAAKSGVYDANIDIAGEVFNNQINIQYSSPAQGEEAANGANITSQIIGIDTSSGQNTYNQTVYVNPKAHTLDNTWVYIKGYQDKIEDSSGKVNAGDTKIKIYEVKDASKISDSYAVNPNDSNLVDVTDNFQDKISYNLENMATIHFGDINKTYVVVVDGHYDNSGKNLKTQVIEENADPTSSQGFSAFGWNNENVVKNGGGTADGEEVVDPEPPVNPDSDSDSDSDSDSDSDSDLDSDSDSDSDSDSDSDSDSDSDSDSDSDSDSDSDSDSDSDSDSDSDSDSDSDSDSDSDSDSDSDSDSDSDSDSDSDSDSDSDTDSDSDSDSDSDSDSDSDSDSDSDSDSDSESDSDSDSDSDSDTDSDSDSDSDSDTDSDSDSDSDSDTDSDSDSDSDSDSDLDSDSDSDSDSDSDSDSDSDSDSDSDSDSDSDSDSDSDSDSDSDSDSDLDSDSDSDSDLDSDSDSDSDSDSDSDSDSDSNSDSDSDSDSDSDSDSDSDSDSDSDSDTDSDSDSDSDSDSDSDSDSDSDSDSDSDSDSDSDSDSDLDSDSDIGRQDGTPGQPHQQGHGEPTHDIAKALPETGYDNSTSNNGTLFGGLLAALGSLFLLRRRKNNNKDSIK

SEQ ID NO: 43279 - protein, 154 aa, Staphylococcus simiae CCM 7213
NDPSTPGEPDVPSNPDTPNDPGTPGEPDVPSNPDTPNDPSTPGEPDVPSNPDTPNDPGTPGEPNVPSNPDTPNDPGTPSEPDVPSNPDTPNNPGTPGESDVPSNPDTPNNSENHKQSELPNTGNESSQNSTLFGSILGLLGITFLSRRRKKEDN

SEQ ID NO: 43280 - protein, 38 aa, Staphylococcus simiae CCM 7213
MNALPETGENDSTYATTIFGGLSLILGTTLLAKRRREQ

SEQ ID NO: 43281 - protein, 2090 aa, Staphylococcus simiae CCM 7213
MNVEKNNKYSIRKYKVGILSTVIGSVLILANPNHSEAYAADQTVSNTASNMVQPTNQQLANQQTATQANTANNPNNKLTTTSTVNNNINQSSDLINSNHQKATDANNVNAKQADTTNKNNNNQPVNDAPKVSNDAMIANHNALIVPENTSTVDHHISLKEIQEQLRHSNDKTNVVAVTEATSNKPKKRTRRQAPGPAPAALANNAANTDPGTNNVGSINEVFTFDNNGINPSPDKLRPAVTVVSNLPGFTMINNGKVGVLSASLVRTSVFNQGDPKNDQASDNVIALGRVLATNTSDTGDFNGIEKIVSVHPNSEVVFQFNTMASADGNGATILVLKNAADDSEIARATVDGGSTLRLATIPANVTDLKIQLLPDASVHGNFRRVTKNQDGYKYFSLVDTIGVKSGSHAYIKNINYNNTIKTDSDLAIDATISNDGNFGASLDNGALVYKVKLPDDVTYVDNSLVTSTPIGNVANTDVNPFTVAYDRTANTVTFSSNGLTAKNGAPNTPMLLPLKEINLKFKVHINRINTPKTVNLESNITYKTYTELTMNNANPPYTTATTSSPLSIIMNKDALQTQYDFIPQQVNYTYASILEYNKLKVRANNILNEQNQNVPVDQRATQQQIDQLVDQMSHTLVSSVNANQQITQKAQQMVNLAENNNDLTDEEKTAIEEQIDNHKNQALNDIDNQTTDQGVTNATNAGIQLLNADVGVPIVKPAAKKAVSDKAAEQKQLNNNNSDATAEEIAAANQKIDTHVTEGDTAIDNATTNDQVAQAKDAAIANISTDVVEPIVKPAARNDINQLAATKRQQLLNIQAATKEEKDAAIANLDQEVTTILNNINQATTNNQVNQVKATGLQTIDGIQPVIAKKPDAKSAINQAAIAHKTVINQSNDSTIEEKQAALSLVDQAVTQAEQAIDQASTNAEVDQLQQTWTTDINNILPATKEKTDARNEVHDQAQQQIARIKANNDATDEEQDAAIQEVNNDETQAVTNINNATTNQDVQDAKNNGINDITQDEPQTTVKTDARAAVTTKANDKKQQLTQTPNATQEEIEVAQNQVDQQLQDALNKINNARKTNDVNTIKDNAIQNIDNDTVIVQKKPDAINQIDQKQQQQEQVINNNTVATEEEKQAALQQLTHLVTQIKNNINQATHNNEVDLATTEGLTQIAQVLPQEVVKPTAIQAINDKYTEKVANINQTPDATKEEKDEAINALNIDKQQAIDAINQATTNTQVEQAKTDGLTTLEGVAANVVKKKEARNTVNQQATSHDADIAQIPDTTVDEQQQAKDKVQTALNNALQQINQSQTNSDVDQATTAGVNTINAIIPQAEVKPAARNAISQANDSQTQVINNNVDATDNEKEAALQRLATAKTQALNSIDQANTNDQVNQLKANAINDINTIVPETRVKPAARERINQHANEKRNQINQDLEATSDERQVALQQLDNIVKQAMQDINNDKTNQQVNDTETQAFDNIAQITPAHNVRSEARNAVEQKFEQQKERILTTPNATDEEKNKALNDLTGLKQQILQQINQLPSTAEVNKAEQNGINNIATILPNVVVKQEAIDDIQNTANTQKQRNKQTPDATHDEINEANQIIDNTVNENKQRIKQVTTNEEVAQLKNKADDMIDKTKPKVRRRRAALDALDQGVEEQIATVDQTPDATDDEKQEAIDKINALRQQLGQQIAQDQTNQQIDHTESKGLEDIKNILPNVHVKKDGRQNINDKAHSQENDINQVSDATDEEKNAAINILHDTTANVLNDINQDHSTQDVQNHVELGNQAIDKIKPETKVKPEARESIKQTLDELLNDINHNQEATIEEKEAATKVLENIYQQQALTAIDNDHTNQQVAETVLKYKQLLLDNNVKPMKKPAISQEINNEVIRANTIIKNYNKVSDKTKNNVLQKIAQLKTAMDNDLRKAISNQEADDVLKRFNHQLHDLETVIATQEQSLIKIDIVANQTIAKFKAIATASQLAHIIQLIEAYKAEGFNMIDGNFDLALIKQQTNEAITKILSIKLPVEPVEEVIMPRKKVTPQTPKVIKKDTPQCSTKVLPKTGGQDFHLPFMEMSLVAGLALIARQLTKKQKGNN

SEQ ID NO: 43282 - protein, 696 aa, Staphylococcus simiae CCM 7213
MKTRQNKYSIRKFSVGTSSILIATLLFMGGGNAQAAEKHVDVGSSQQSTVTAQSIGEEQTREADSEQSSTADKLQKSEDQANTTNLHSNKGIIEQDERDTNEALNNNQDETPGASTKDGGIEAQASTKEATTTDKEEQHNTKNDAQQNHQQNTNANDEVKHNKQAKDQQIEATTNLTKDNTNSPAAKVNRDDSEGSFANNQKQNSTVTSAGNGQQVSENEGKVERQGAEQQQVQQQDVKPEEQRVTASTSKKTTPVLDQLNHTKMDDNSQDKDQKQHRDLDVLKNNAVVTPPSKSSSQRVSQTKDDQTNKVAKQGQYKNQDPIILVHGFNGFTDDINPSVLSHYWGGDKMNIRQDLEQNGYRAHEASISAFGSNYDRAVELYYYIKGGRVDYGAAHAAKYGHERYGKTYEGVYKDWQPGQKVHLVGHSMGGQTIRQLEELLRNGNQEEIDYQRQHGGEISPLFQGNHDNMVSSITTLGTPHNGTHASDLAGNEAIVRQVVYDLGKMFGNKNSRVNFGLDQWGLKQQPNESYIDYVKRVKNSKLWKSQDNGFYDLTRDGATELNRKTSLNPNIVYKTYTGEATHKALIGDRQKADLNMFLPFILTGNLIGKATEKEWRENDGLVSVISSQHPFNQAYTDATDQVQKGIWQVTPTLHDWDHVDFVGQDSTDTARTREELQDFWHGLADDLVQAEQQTT

SEQ ID NO: 43283 - protein, 549 aa, Staphylococcus simiae CCM 7213
MKKKSGPINKRVDFISNKLNKYSIRKFTVGTASILISSLMYLGIQNDAQAAENDANNQPENVTAESNSNIKSVDSNSKLQDVKSSENEVRNTSEGTQDTLEKNVETPNTEDNKVEKAVQPENTNVKEAATDSTAEEVKEEKATQPDSTNAKELEADSKAESAKEDKAAQLENKNIEKTEKSSTVESAKVKQAAQVEKSNVEKEKATSNSTKVNKPTLNKNTAVKQAEKKANVESTNTVTPRVAETVNAKKPEGLNVRVRSTRSVDNTPSVPSSNTRNVAEIPPVTLRGKDKFNNYGSVDIQNRPNDLDSPEVTRFNNVGDGTYGLKGAIQLKSPISFDKDFEFNIRVANNHQSVTTGADGWGLLFTKGNGNDYMQKGGILGPKGIENSAGFRIDTGFNSNDPMDKAEKQAGQGFRGYATFVKNGSDGTTSQVGQNIPNKGKADNSFAYADNATDTTDKKFHGQLLNNVKLKYNAATGKIRAEYANKVWEASISDLGLSKDDTYNFLITSSQRLGTVGGNAGQGTHANGWMRTDLAESTFELTPKVENKT

SEQ ID NO: 43284 - protein, 197 aa, Staphylococcus simiae CCM 7213
MKKVGILGTTALAGTLLFTGISSHEANAAESSVNANNAQSIATQVWKEDGNQPELVDFKQAQDKGDYYLLVYNNKSHVGNGAVRVYKDGTVESGSGVLATGDEGEFYKNGKYQFDDVNNNDQTQTQQQTTTNNNVVATQNGQQTQEQTTSQTQQQEQAKELPATGEETNTGFVASIATALLAVGSLLTFKRFSKNNK

SEQ ID NO: 43285 - protein, 156 aa, Staphylococcus simiae CCM 7213
AKPSNPGTPDKPSNPSTPDKPSNPGTPDKPSNPGTPAKPSNPGTPDKPSNPGTPDKPSNPGTPDKPNNPENPQNRQHNQQHTVKTGKEQYFKYNAKISYHKVEHKQTVTNDDTTKHQLPSTGGMTHSYNTELFGSLFALASSLLLLGGRRRQQKSQ

SEQ ID NO: 43286 - protein, 189 aa, Staphylococcus simiae CCM 7213
MKKLSILGATTLAGTILFTGIGHQAQAAEQLNMNNAKDIAIKASSNDQAKKASFSPEGNSDIANPAYTTTKSGNDYIFSSPEGAYTYRLTNDGKLYITTKYDGKEHFISQENVEESSQQATQKQAPNNNQVTNETPQHINQSQQQVQSQATVLPTTGKDEVNSSLVTSIATVLLAVGSLLTFKRFSNNK

SEQ ID NO: 43287 - protein, 25 aa, Staphylococcus simiae CCM 7213
MAADIISTIGDLVKWIIDTVNKFSK

SEQ ID NO: 43288 - protein, 260 aa, Staphylococcus simiae CCM 7213
MKKTLIASSLAVGLGVVAGNAGHDAHASEADLNKAALAQMAQSNDQSLNENPIEAGAYNYTFDYEGFTYHFESDGTHFSWEYHATGAANADVSAQATTATNETAPSQVSATQQANSAQPQQVSAPQTSQINEPQTTAVNDTQQQGSSQQQSVQSSNNTQQATQQQSSQASSNDSKADSGSSVNVNSHLQQIAQRESGGNIHAINPSSGAAGKYQFLQSTWDSVAPAAYKGVSPAKAPEHVQDAAAVKLYNTGGPGHWVTA

SEQ ID NO: 43289 - protein, 189 aa, Staphylococcus simiae CCM 7213
MKKRNVLGTTALAGVLLFTGVGHQAHAAEKKIPVYVFTEKEFNENRTGQTEGFGGGPGSDVSVVIGDESYQEYLARVKAGEKLSESLAPIEYIYPDEAQSNGQVNNKETQSPAQSNVAPQQTDNPPVNNQVGTQGDTQATTQAPEQSTVQQLPQTGEQQTTTTWMTLAASVLLAVGSLLTFKRFAKNTK

SEQ ID NO: 43290 - protein, 53 aa, Staphylococcus simiae CCM 7213
EAKKTVAEFQRKRTIATHRKAQRAVNLIHFDYKYEKKKLQKQIDIVLKYNILK

SEQ ID NO: 43291 - protein, 57 aa, Staphylococcus simulans
MENSKVMKDIEVANLLEEVQEDELNEVLGAKKKSGVIPTVSHDCHMNSFQFVFTCCS

SEQ ID NO: 43292 - protein, 26 aa, Staphylococcus simulans
MAGDIVGTIGEFVKLIIETVQKFTQK

SEQ ID NO: 43293 - protein, 493 aa, Staphylococcus simulans
MKKTKNNYYTRPLAIGLSTFALASIVYGGIQNETHASEKSNMDVSKKVAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKALVQNRTALRAATHEHSAQWLNNYKKGYGYGPYPLGINGGMHYGVDFFMNIGTPVKAISSGKIVEAGWSNYGGGNQIGLIENDGVHRQWYMHLSKYNVKVGDYVKAGQIIGWSGSTGYSTAPHLHFQRMVNSFSNSTAQDPMPFLKSAGYGKAGGTVTPTPNTGWKTNKYGTLYKSESASFTPNTDIITRTTGPFRSMPQSGVLKAGQTIHYDEVMKQDGHVWVGYTGNSGQRIYLPVRTWNKSTNTLGVLWGTIK

SEQ ID NO: 43294 - protein, 1674 aa, Staphylococcus simulans
MGNKQGFLPNKLNKYSIRKFTVGTAPLLVGATLVFGIGSEAQAAELDTITKEDVKSRDKGEALDIKNIKESEKDVTTEDDNNAQVQNSAQTVDKSENSNDTAVESTNDSVKTDETKETSENKSAQDDDNIKEDSNTQEESTNTSSQSSEVPQTKKDTNETSETAIDEDASIKEQNNKDNDTAQDDDNIKEDSSTQEESTNTSSQSSEDSQTKKEQPDKSSNSIKEPDKQQEEVAKEEKATTEIADKNKELELKNNKTDKNEESELESNLSSSENKKDTVESFLNSQLSDSETKKIMENANIDYDKATDEEINTEILRASLIEMANNKKKTETLATPQRTMFRAMATPTALRAAVYPDEELPKSLGYTDDYTFASMLFDPGKLDSDDALNSNIIPFDLHSYMSGANSGNRYKIDLKLDPIIAEHVTKISANPSGSNKPVEFVRIKDENGNLTDTWEVNFIRANDGLFGGAEILSQYTAKNGKIELDDTVGNIVSNAGNLSNNKLNYQVFVRDSKENKIVRTSESSGYFLTKADNDLVNLENNVSTENNNAFKASSGSATYNKDVGEFGGILIDQQIMKNGIFSYSKTKANQWSYNYQIDKDLLPYIEGVELHQYEYKGLEGFDKNYDAKNKVANLTIDEVGNGTITSDNLNKLIEFNNALPETVGVRVVLKLNQSVNNILTKDAKYDSEGNLIRETIKQKEDFTFAGYLTDSKGALINNTLGTSTLALQDYDKDGLLDRYERQVSLSDAESEDTDGDGKNDGDEIINYKTSPLVGKPHAAHITTEDTDGSGSVPLKEGAATQTAKVINAEGTTVGTTTVNSDGTFSVSIPNSPEGTYTIAIDSPNYDNDEVNTFEIVDNSKLPAPSINPVDDNDQQIVVNGTSGSTVTVTDSNNNVLGTVTIPADDTSAAINVDTPLEAGTVLTSTASKDGKTSDVSDQITVTDATAPDAPTLDEVNTDATQVTGQAEPGSTVTVAFPGGGKASTTADDAGNFIVDIPSEVNLEGGETFTATATDKTGNESEPSTTTVVDTTAPDAPTVNDVTSNDKVINGTAEPGSTVKLTFPDGTTATGTADDQGNYTIDIPSNVDLNGGEELQVTATDKDGNTSEPSSANVTDTTAPDAPTVNDVTSDATQVTGQAEPGSTVTVTFPDGTTATGTADDQGNYTIDIPSNVDLNGGEELQVTATDKDGNTSEPSSANVTDTTAPDAPTVNDVTSDATQVTGQAEPGSTVTVTFPDGTTATGTADDQGNYTIDIPSNVDLNGGEELQVTATDKDGNTSEPSSANVTDTTAPDAPTVNDVTSDATQVTGQAEPGSTVTVTFPDGTTATGTADDQGNYTIDIPSNVDLNGGEELQVTATDKDGNTSEPSSANVTDTTAPDAPTVNDVTSDATQVTGQAEPGSTVTVTFPDGTTATGTADDQGNYTIDIPSNVDLNGGEELQVTATDKDGNTSEPSSANVTDTTAPDAPTVNDVTSDATQVTGQAEPGSTVTVTFPDGTTATGTADDQGNYTIDIPSNVDLNGGEELQVTATDKDGNTSESTNTTVIDSDDNSDNGNNSGAGDNSDSDNNSGNGNNSNAGDNSDSDNNSDSGDNSNAGDNSDSDNNSDSEDNSSSNKDSINQDSNVNSNDSKHDKQNELPETGEKEVRNGTLFGTLFAGLGSLLLFTKRRRKENDKK

SEQ ID NO: 43295 - protein, 434 aa, Staphylococcus simulans ACS-120-V-Sch1
MPIITDVYAREVLDSRGNPTVEVEVLTESGAFGRALVPSGASTGEYEAVELRDGDKKRYGGKGVTKAVENVNEIIAPEIVEGEFSALDQVSIDKMMIQLDGTENKGKLGANAILGVSIAVARAAADFLGQPLYKYLGGFNGKQLPVPMMNIVNGGSHSDAPIAFQEFMILPVGADTFKEALRWGAEIFHNLAKLLKGRDLETAVGDEGGFAPKFHGTEDAVDTILEAIKTSGLEPGKDVFLGFDCAASEFYEDGVYDYTKFEGEGGAKRTSAEQVDYLEELVNKYPIITIEDGMDENDWDGWKQLTDRLGKKVQLVGDDLFVTNTKKLSEGIEKGIGNSILIKVNQIGTLTETFDAIQMAQKANYTAVISHRSGETEDTTIADIAVATNAGQIKTGSLSRTDRIAKYNQLLRIEDELYETAEFDGIHSFYNLDK

SEQ ID NO: 43296 - protein, 645 aa, Staphylococcus simulans ACS-120-V-Sch1
MKKNNQTHHHYAIRKFTVGAGSTLIASFIFMGLSTSAYAEESTQTHHETQVEAEHTQENEQLLPSKDITTAQQVETQPDFSTKRSETQTNHVNTPSSEKNIQEQNTTNLEQEASSSQIHEGSQTKQEKPNHSEPLKPNQYEQPAPVDNDSVTNYEEQKVTEDVIQQVEAPENKKEEIKNTEILSKTTSTSEEETVQTHVSSEVEPKTAPAPEIKSTLTSQEDDEKTEAAPKEEAKTEESQTKPTQRTVQQAPVPHTESLKTNKAQQAINQYPVIFVHGFMGFTGEIKPDLYPNYWGGDKYRVIDGLREKGYEAYEASVGAFSSNYDRAIELYYYIKGGTVDYGAAHAEKYGHSRYGRTYAGVFHEWAPGKKVHMVGHSMGGQTIRLLEHFLRFGNQEEIDYQRQHGGTISSLFEGGKDHMIASITTLGTPHNGSAAADRIGNEKAFKDIVYALGRMGGGKLANIDFGFEKWGFKQRENESYIEYAQRVAQSKLWDTDDNAMYDLTSEGSEKLNQMTPMNPNIVYTTYTGLASHEGLTGNHIPDIGQFFLFDSTSRVIGSEENQALRPNDGIVSVVSSLYPTGQDFTEFTDGLKKGIWQVTPVMKGWDHLDFVGLDALDFKHTGQELQGFYAGLINHMMRIEELDI

SEQ ID NO: 43297 - protein, 4190 aa, Staphylococcus simulans ACS-120-V-Sch1
MKKLDFLPNLRNRYSIRRFTVGTASILIGSLLFLGNNGEAKAAENTNDNTVVEASKDTSASQQKSVENPVPQENTANTTKQVENTPTSQNVLETVKTDALSKLSTFTHLTEETVKQYTAEVKQAQTEADVQAVVDKAQKAEAEAAKQAEAEQAKTVDATKKQSAATTEVPKSTTESVKEETKADTTSATTSETNNTSEAKTVTSTDQATPTIETTPLSTEQKVDKVKTELASDYDSSKVDAALAVIDTTDLTEDQIKAEVLKLLLEQGSAQKDLYSPQATKLRSAVEEPTTAVRAFSVDTSLKDDVVVTPENFNQYFNTNMDATYDQATGIATLTPDLKTKRGSISLDTKMNIDKDFRFVGKVNLGDKGEGHLKNGLPGGDGITFIFNSGNTNEIGLFGAAVGMGGLKNSFGFKLDTYITSGGDPKNKALGDPGQFNGKSSYGAFVKTDGAGMMSVDFGTAKALTAQPHENQFQDFIIDFDGDTKNMTVTYGGQTWTKNLKTEIARTHKNVFALSIAASTGGAFNLQQVQIDNFTYTASALLEQDFVDQDTQELIDKPIRTSGDVNQTYTIPSHDQYLKDRGYQLVNEDYSLAPNYNTATHQVKLTNASQFIVYHVKDVQAPVIGDVANTTVDVDTEMAPLVLNITDNSNHFRSKTVTGLPEGVTFDENTNTISGTPTKVGTSTVTVTATDNAGLTTTKTFKYIVADTKAPTITPVENKTTEAYTPIAPITLSADDNSKVAPTLTVAGLPAGLTFDPATKQITGTPTAEGTSTVTITATDAAQNAATSTFDITVKPNAALEALKAAVADAKTVAKDDFTPKSVAALDAKVAEGEALLANPEKGSTDAFNAKAQEIKQAKDQLVHKADKSELEKAIAEAEKITNLDPNKPMDQQLKTALVNAKTTDADLNATQQATDDSKNNLNHAIQEKLRADAYEKLQEAVKKGVEVASADGYTPNSVEAVKDTIKKVNPLVIASMSDDPTVREQYSVDQINEATKAINDSIAGLVKKADKSELQKAIDKAGTLGQLNASDTEDKAVQDALDKANQVKADGNATPQQVTEATDALNQAIDKKLYQDALDELNAAIKDAEAVKKDNYTPETVTPFEAAITDGKAKAADTNATPEQLKAAAEAIKTAKDALKQKANKVELEKSIATAEALPPLKAGDPEDDAIKAALDKAKQVDANQNADQAAVDAAKEALDNAINVKKAQDAKEANDAAAAKQAALDALKDELAKVAKLDKDSYTPNTVAPLNEKEIDGKAIVANPDNKTTEEIEAATQALKDAEKDLVKKADKAELQKAIDNAKGLGQLDSTDKEDKAVQDALTKAEQVNADGNATEQQVADATKVLNDAVAAKERQDALDELQKTLDAANAVKKDDYKPSTVTPFETAVQAGEAAKADTSKTPQELKEAAQAIKDAQNALQAKANKAELEKSIATAEGLGQLNANDPEDKAVQDALNKAKAVQADQNADQAAVDAAKKALDDAINAKKAQDAKEAKEAADAKQAALDELKEELAKVAKLDKDSFTPNSVTPLNEKENDGKAIVANPDNKTTEDIKEATQALKDAQNNLVQKADKAELQKAIDKAKTLGQLDPADKEDKALQDAVTAGEAVKADGNATPQQVAEATKAINDAIAAKERQDALDELQKALDAANTVKKDDYKPSTVTPFEAAVQAGEAAKADTSKTPQELKEAAKAIKDAQNALQAKANKAELEKSIATAEGLGQLDANDPEDKAVQDALTAAKAVEADQNADQAAVDAAKKALDDAINAKKAQDAKEAKEAADAKQAALEALKAELEKAKAVQKDNFTPDSVKPLTDAETSGQAIVDAPDGKTTKEIEAATQALKDAQKDLVQKADKAELQKAIDKATGLGQLDPADKEDKAVQDALATANTVNDNQNATPQEVQQATEALNNAIAAKERQDALDELQKALDDAKAVKKDDYKPSTVTPFETAVQAGEAAKADTSKTPQELKEAAQAIKDAQNALQAKANKAELEKSIATAEGLGQLDPADKEDKAVQDALNKAKEVQADPNASQDAVDAAQKALDDAINAKKAQDAKEAKAAADAKQAALDALKEELAKVAKIDKDNFTPHTVAPLTEKEDAGKAIVAAPENKTTKEIEDATQALKDAEAALQAKSDKAALQAAIDKANALGQLDPTDKEDKALQDAVTAGEAVKADGNATPQQVQEATKAITDAIAAKERQDALDALQKALDDAKTVKKDDYKPNTVAPFEAAITAGEAAKADATKTPEELKAAAKAITDAKNNLEAKANKDELNKAITTAEGLTLDPNDKEDKAVQDALAKAKEVQADQNATQATVDAAKAALEDAINAKKAQDAKEAKEAADAKQAALDALKQELAKAAQVDKNNYTPDSVKPLTDSQTAGQAIVDAPENKTTEEIEKATQALKDAQAGLVAKADKAELDKAITAAEGLTLDPNDKEDKAVQDALNKAKEVQANPNATQEEVNAAKDALNKAIEAKTAQNQADAVKAALDALKAELEKAKAVQTDKFTPDSVKLLTEAETARQAIVDAPTGKTVEEINKATQDLKDAQAGLVAKADKTELEKSIATAEGLGQLDPADKEDKAVQDALAAAKAVEQNPNATQTEVDNAKAALDEAINAKKAQDEKEAKAAADAKQAALDALKAELEKAKAINKDEYTPDSVKPLTDAQTAGLAIVDAPDNKTTAEIEAATQALKDAQKDLVQKADKAELQKAIDKANTLGNLDANDPEDKAVQDKLADAERVKADDNATPQQVAEATKALNDAIAAKEHQDALDELNKAIDAANAVNKADYKPNTVKPLEDAVKAGEAAKADATKTPQELKDAAKAITDAQKALEAKANKDELNKAITNADGLTLDPTDAEDKAVQDALNKAKEVQADPNASQADVDAAKEALENAVNAKNAQDAKEAQAAAKAKQDALDALKAELEKVAKINKDNFTPNTVAPLTEKEEAGKAIVANPDAKTTEEIKEATQALIDAENALQAKSDKAALQAAIDKANALGELNPADAEDKAVQDAVAAGEKVKADGNATPQEVADATKAINDVIAAKEHQDALDELQKAIDAANAVNKDDFKPNTVKPLEDAVKAGETAKADATKTPQELKDAAKAITDAQKALEAKANKDELNKVITAAEDLTLDPADKEDKAVQDALAKAKEVQADPNASQDAVDAAKAALEDAINAKNAQDAKEAKEAADAKQAALDALKAELEKAKAINKDEYTPNSVKPLTDAETTGQAIVDAPDNKTTAEIEAATQALKDAQAGLVAKADKTELDKAITTADGLTLNPADKEDKAVQDALEKAKEVQANPNATQDEVNAAKDALNKAIEANTAQDQADAKQAALDELKAELAKVAKIDLNQYTPDSVKPLTDKEIEGNAIVAIPDGKTTEEIEAATQALKDAQAGLVAKADKTELDKAINNAEGLTLDPTDKEDKAVQDALEKAKAVQANPNATQDEVNAAKDALNKAIEAKTAQDKADAVNAALDALKAELEKAKAINKDDYTPNSVKPLTEAETTGQAIIDAPTGKTVEEIEAATQALKDAQAGLVQKADKSELQNAIDKANAIDNLEATDKEDKVILDAVAAGEKVKADGNATPQEVADATKAINDAIAAKEHQDALDELNKAIEDAKAVNKDDFKPNTVKPLEDAIKAGETAKADVTKTPEELKEAAKAINDAKNNLEAKANKDELNKAITEAEGLTLDPKDKEDKAVQDALDKAKAVLEDPNATQEAVDAAKDALNKAVEAKATQDKADAVNAALEALKAELEKAKAINQADFTPNSVEPLVDAIAVAQGIVNNPESVTVDQIKAATQALKDAQAGLVAKADKAELDKAINNAESLTLDPTDKEDKAVQDALDKAKAVQADPNASQAEVDAAKSALEDAINAKIAQDKADAVNAALEALKAELEKAKAINQAEFTPNSVEPLVDAMAVAQGIMNNPESVTVDQIKAATQALKDAQAGLVAKADKTELDKSINDAERLTLDPTDKEDKAVQDALDKAKAVQADANATQTEVDAAKDALNEAIEAKATQDKADALAELQNALDKAQSTDKTKYTPESVEKLDVSVNTGKAIVENSKEVSIKDIQETTKAIEDALKALEVIKAPKIEKETDKVKSTSGKSVERTSDKAVKKSEGSKAQTKANKAKVLPNTGQETPADSKYATLMLAIGGLMALFGRRKKEDKDNTEK

SEQ ID NO: 43298 - protein, 253 aa, Staphylococcus simulans ACS-120-V-Sch1
MKKLLVASTAVTAAAAVLATGIGTQDVQAKSSSKAEHAKKVKDAEKYLNEKGEYTVVKGDTLNKIAKKFDVKVKELKKWNDKKSDLILVDESLKVKEPKKVATTQTAVQSDSHYAYNTQQVSYNNYNQAQSNNAPQSSYTAPQQSYNAPQASYSAPSYASYGSGSVRLANGNTAGSTGAYAAAQMEARTGVSASVWENIIARESNGQVNAYNPSGASGLFQTMPGHGSTATVQDQINSAVHAYNVQGLSAWGY

SEQ ID NO: 43299 - protein, 673 aa, Staphylococcus simulans ACS-120-V-Sch1
MHKKAHINQNYSIRKFTIGTASILLGTGIFFSISHNADAAETTTSYQGVTEKAQTPSPSSPLTAEQSQALSASNPTTPTTITPTASSEPVTAPVINATSNCYKIGDYAWVDADADGIQGEQEQPLANVKIELSQNGKTIATTTTDANGKYLFTNVANGAYELNYESPEGYTPTQSQAGEDITVDSNNIPDEVIINNEDDLTVDVGYLQDELTPVAKYNLGNFVWNDLNRNGIQDQDEPGLKDVQVTLTKPDTSTQTTTTNDIGNYEFKDLPNGKYKVAFATPVGFEPTLTGQGDLDVDSNGVTTDVEIADAYNEFVDSGFYKKPTSFKLGDLAWIDADGDGVQGELEKGLAGVTVELIQNDQIIASTQTDEKGHYQFDNVANGTYQVAFSVPDGYSPTQVQAEDDVTKDSNGTPVDVTINNADDLTVDIGYLVDIPAPVAKYNLGNFVWNDLNHNGIQDKGEPGLKDIQVTLTKPDTSTQTTTTNDNGNYEFKDLPNGKYKVAFAMPVGFEPTLTGQGDLDVDSNGVTTDVEIADAYNEFVDSGFYKKEVEQPKKDESKVDEINNNPPQITEEEIDYSTQLLEQPNQYMDDNMNEVTLLEKVTPEYEDYTDYSTLLLEQSNKADQESEYDMDVSTLIKSSTICFKSNYADNYHSNCIVRTSDCPRNKCNKQLL

SEQ ID NO: 43300 - protein, 3227 aa, Staphylococcus simulans ACS-120-V-Sch1
MKKLDFLPNLRNRYSIRRFTVGTASILIGSLLFLGHSGEAKAAENINDNNTVVEASNDSSTTQQAPEENNKTSLEKTVDATQQQTDNKAQTQNALEEVKKQATTEITSLKNLNKEEVDSYTLEVQQADSESTVHAIVEKAKAAAQAVEQKEESIQTQKTENSKESTETTVEKTKETPSTEAEPVKAEATVEKASEPVVENKEEAPESVVTPATEPAVEKAVETVTETSVLSPEQKVEKVKADLSNDYDSAKVDAVLAVIDTTDLTPEQLKSEVLRLLLEEASAQKDLFSPQATLPRTGEEASGYSTRAFDLEEAASQEIVVTKENFGEYFKTLNDATYDSQSGVVTLTTNEANKSGAMSLDFKLNLTKDFSFSGAVNLGDKYEAHPKDGVTGGEGLAITFNPGKTYTLGLTGQGFGIGGESSSFGFKLDTFVNKANDDKSKAFSDTIQFENKGAFGAFIYTTETGLVNTVIINPNASGNAALLKEQPNNQLVPFKFNYNGTTKVMTITYGTQTWTQNIQDYINYSRKDSFAFSIVASTTDHYNLQQIKLDEFRFTASAVLDEYFIDDDTEEAIDKPLRTAGDVNEKLTLKDHAEYLAEKGYEFGTEKVRDEAHAIGYDEGAGTVTLENDAQQLVYTVVDIQNPTIAEVTDVTTNVSEAITPITLDITDNSGHFDTIAVTGLPTGLSFNETTKQITGTPTTPGDATVEVTATDMAGNTTTKTFKISVAGAQAPTITPINAQTGEAYTPITPIAVNVEGDLNPAPTVAVTGLPAGLSFDAATKQITGTPTAEGTFNVTVTATQEASEPATSTFNITVQPNAALKDLKAAVADAATVNKDSYTPNSVEAYEAKVTAGDTLAGQPENGSNAQFADASKAIKDAKNALVPRADKAALNQSITTAEALQPLEAGDPEDDALKTALETAKTVQGDLNIDQPAVNKAKTDLDNAIAAKNLQDELDKEDALDELRKTLEYVETIDPAQFTTSSKKAFTEALTNAKTILGSPGSKTIAEIKAATNALEDAQNVLVPQADKTALKTAINTANGYNNLNPNNPVDKALQDKLAAANAVNTNGDATADQVKTATDDLNTAITAKKAQDDQIAKDAAAKKAALDALNDELNKVKALDKATYTPNTVTPLTEKQTAAQAIADAPDTKTTEEINAATKALKDAQNALVPKANKDDLNNSVKTAEALPLNPADTEDKAVQDALDKAKTVQADDNATQDAVNTAQTDLDNTVAAKKAQDAKDAAAKQAALDALNDELNKVKALDQTTYTPNTVTSLTEKQTAAQAIADAPDTKTTEEINAATKALKDAKDALVPKADKTDLQKALDTAKAITGLEPTDKEDKAVQDAIDAAQTVNKDDNATPQQVADATKAINDAVATKAHQDALDQLNKALEDAAKVDKTDYTADSVKPFDTAVKAGKTAAGDNTSTVEALNNATKAVKDATAQLVPDKSKLDTAITEAKALEPLTDSNTDQLLKNVLNAAETVKNNPNATPEEIKTATWNLEDEINNKKAADAIEALKSAVNKAEQLNEAKYTPNTYEPLKTAITEGQKIINNPPSADTPATLAKAKQIEELVNALKERADKTELGNALDKAIAYGDLNPNDAEDKALQDAVTAGQKVNGDGNATTEEVANAVKTINDAIAAKERQDAVDELTKAINDAKTVNKDDYKPNTVTPFETAVTAGETAKDDATKTVEEIKAATKAITDAKNALDKKADKTELNTSVTTAEKLGAFDTKDAEDKAVQDALDKAKTVQADQNATQEAVNTAKTELDNAVNAKKDQDAKDAQAKQEALDALKAELDKVKAVDKTVYTPNTVTTLNEKETAGNDIVAAPEAKTTEEINQATQALKDAQNALVKKADKTELQKALDKANTFTDLAATDKEDKAVQDAVEAGNTVKADDNATVEQVEKATKAINDAVAAKERQDALDELNKAITDAKTVNKDDYKPNTVTPFETAVTAGETAKDDATKTVEELKAATKAITNAKNALDKKADKTELNTSVTTAEKLGALDTNDKEDKAVQDALDKAKTVQADDNASQEAVNTAKTELDQAVAAKKTQDELDALKKAALDELKAELSKVGKLFYKDYTPDSVKPLADKEVLGNAIVTIPELKTTEEIKAVTQELKDLQKALVQKADKTELVKALEKAKTLGALDATDKEDKAVQDAVTAGNTVNEDGNATTEQVANATKAINDAIAVKERQDALDELQKAIDDANTVKKDDYKPNTVTPFEAAVTAGETTKDDATKSVEEIKAATKAITDAKNALDKKADKTELDTSVTTAENIGALDTNDKEDKAVQDALDKAKTVQVDQNATQEAVNTAKTELDNALNAKKAQDTKEAVEKQNALDALKAELEKAKTVNKELYTTNSVKVLTDSETAGQNVVDNAANKTTQEIEEATKALKDAQANLVSKADKTELVKALEKAKTLGDLVATDKEDKAVQDAVTAGEAVNEDHNVTQEQVANATKAINDAIAAKERQDALDALTKAIKEANSVVKDEYKPNTVTPLEEAVKAGETARADATKTVEELKQAAQTITDAQNKLELKANKEELNKVVKTTETLELNPADKEDKAVQGALNTAKEVQVDQNASQETVDKVKTDLENAVKAKTTQDKVDAFNKALDALKAELEKVKTIDKDFYTPNSVKPVTDAETAGQTIVNNSADKTVEEINKATQDLKEAQKHLVEKADKVELDKVIDTAENTELNVNDKEDKAVKDALDKAIKVQEDLNATQEEVDKAQSDLAKALENKAAQDKADQEKVQAFNKALEALKAQLASSRTVVKDNFTPNSVAPFQEAQAVAQGIVNNPESVTVEQVVKATEVLKSTQSSLVTKADKSELEKVIETAEGLDLNVTDKEDKAVKEALDTAVTVEADQNATQESVNKATSELEKAIENKVTQDKVDAFNKALEALKAQLASSRTVVKDNFTPNSVAPFEDAQAVAQGIVNNPESVTVEQVVKATEVLKSTQSSLVTKADKSELEKVIKTAEGLDLNVTDKEDKAVKDALDTAVTVEADQNATQESVDKAQSDLEKALETKAAQDKADAVAKAKADALAELEKALDKTETIDKSKYTPESVEKLDQAVVDGKVIVEKADNVSVQDIKEATKAVETALNGLEKVKAPAKETGKTTESTLNTAKSDTKSDVKAQDKQTSKGTKGTKAEKAGATKAKAENAGKNKAKALPETGQDVSSIDPQYASLMFAIGGLMMFFRKRKNEDKDNTEK

SEQ ID NO: 43301 - protein, 225 aa, Staphylococcus simulans ACS-120-V-Sch1
MKKLLVASSATAALFAVGVGAEAHASEQGNADQAQLAETALNNPEQLNESPVQEGAYNINFEYNGLDFNFESDGQYWSWSYGQAGGNAPAAQTTTQQAPAAQQAPVAEQAAPQAQEATTQQAPAQQAAPQAQQAAPQQSASTGSSAGLNDHLRAIAQRESGGDIHAINPSSGAAGKFQFLQSTWDSVAPAEWVGKSPASAPESVQDAAAVKLYDGGAGAGHWVTA

SEQ ID NO: 43302 - protein, 1162 aa, Staphylococcus simulans ACS-120-V-Sch1
MKDEHTSKNKASFQPDRKNKYSIRKFTVGTASILVGAILLFGVNTQDAKAAETSTTSTINATTPDKDTNVEVNHADAVVNETAVTTSSEITTPDETKEVPKTEVESLPTKVSNDSTEKATSDHQEVVAPTVEKEATAAPKSQEVSTETAPFETNTTVQKVAETPKVEVPQSILDIQQVQDLNTAAEFYAQSSGVSIEEAKTLIQELNLDSQATPEEIQQALLYQLSHEYETWYKPAVREDLTTEAEQVADNPDFVKYAVTLPIEPIIIDADAIKNGYVRSGSDELSKTNLISGRAWMADQGIPSVGTNGLAPVPVNTPVYLQWMDKDGSISPIYRAYTHNKNRDDSAQDGPGAFAFDLRQGWTDATGKHHVYKAFKGQKYRFAIPDFTLPNGNKATMLRQAGGFYPGVFVDTFTDNNMGQTPVVGKNIGRTGIFMAEVPVGNYMTKPKNQWITSEGNHSYPELLAVDGYNVVRGKVWIESSGGDRANSATGPNYNPNLGDRVAAGYKVVLSSLTSQGAAAYRNEVQRVPVHERAAAAKRLLTAHPEYISATVVSVVDGNGVYAAKFPNGTLDVDHIYGFVLNTKGKLVQTYSGFTSPEFRKANQNISFVPISAPYSGVQQWANVNFAVVLSPSDTIDLHTVPYNATDNPAAPGSRVNVKLPNGDVPPMPTHIEWRDPSGQTVHRAPDFTTPKRGEQVSGFTIPKEAQEGDIYTAVLVSGGNDIAGSSVIVHITEANKYPPKAQTVTKEFGQPATEEDVMSHVTFPKYPAHLKKPTITIDHPDKLPDGNTPGKVLVPVTVTYPDGSVAHVNVPVVTKAQSDKDKYTPTAGSVEKDFGHKATPGEITGKVSVPDFPAGGNQPTYTVDETTIPDGQTPGTVNVPVTVHYPDNSSEVIEVPVTTKVQPDNDKYQPATEAIHKPFGQKTDENEVKSKVSVPNFPGNGNQPTYTVDTSTIPDGQTPGTVNVPVTVQYPDGTSEVVNVPVITGPKDSDTYQPTTGEITKPYGQATTEQEVKDKVAVPNFPKDKGTPTITVDTSKLPNGQTSGEFQVPVTVTYPDKTTDTVNVKVTVGVQPDNDKYQPTAGEITKPYGTPTTSNDVTGKVSVPNFPKTGAQPVITVDTNNLPNGQTSGVFQVPVTVTYPDKTTDTVNVKVTVGPKDSDTY

SEQ ID NO: 43303 - protein, 1088 aa, Staphylococcus simulans ACS-120-V-Sch1
DGKTSGEFEVPVTVTYPDKTTDTVNVKVTVGPKDSDTYEPTTQPITKPFGQGTTEQEVKDKVTVPNFPADKGTPIVTVDDSTKVPNGQTPGTFDVPVTVTYPDGTKDYVTVKVTVNPQPQNDKYEPTAGEITKPYGTPTTPEEVKEKVSVPDFPKDGGKVVVTIDDPTTVPSGNASGVFEVPVTVTYPDGTKDHVTVKIVVTPQPENAKYEPVSKDIEKPYNQPTTVNEIVNQVTVPDYPTTGNQPKVTVDNPALIPDGKVPGEYEVPVTVTYPDGTKDHVTVKVVVTPQPENDKYEPVSKDIEKPYNHPTTVNEIVNQVTVPDYPTEGNQPKVTVDNPALIPDGKVPGEYEVPVTVTYPDGTKDHVSVKVTVGPKDSDVFEPVAGKVEKPYGTPTTIEDVVSKVTVPGYSKVDNPYKVTVDNPSVLPNGNTPGVYDVPVTVTYPDGSTDHVTVKVTVNPQPENDKYEPVSKDIEKPYNHPTTVNEITNQVTVPGYPDTENPYKVTVDNPTLIPSGSISGVYDVPVTVTYPDGTKDHVSVKVTVGPKASDVFEPVAGKVEKPYGTPTTIEDVTSKVIVPGYSKVDNPYKVTVDNPSVLPNGNTSGVYDVPVTVTYPDGSTDHIIVKVVVGPKDSDTYEPTTQPIEKPYGSHTTIDEIVGKVTVPGYPDTEKPYKVTVDNPTLIPSGSIPGVYDVPVTVTYPDGTTDHINVTITVHPQPDADVYNPGYNDVQVNPGESIEIPQVKDDVPTGTRFEIPSESGIDKDWTVTVNPDTGKITVTVPEDAAEGDVVTVIVKVTYPDGSTENVTVDVTVHDSIAPEAPVVNPIEAGDRTVTGTGKEPGSTVTVAFPDGSTVTTKVDKDGNWKVDVPEAVTLKDGDNVKAVITDEAGNVSKETVTPVKDTVAPEAPVVNVIHAGDKVVTGTAEPGTTVTVTFPNGTVVTVKVGQDGTWSVDVPSNVMLKDGDKVTVVATDKAGNISKSSTAIVVGDKEVVPAPNKEKINTPESGGTNTIDTNTTDGNNKSSKVGVSTVKDESSNKTADKSKAKSTAKALPDTGKDTVNSGVLFGGLFAALGSILLFRRRRNHDDNK

SEQ ID NO: 43304 - protein, 712 aa, Staphylococcus simulans ACS-120-V-Sch1
MNKQLNNFEARRHNKYAIRRFSVGTASIIVGTTLLLGLGHEAKAAEEITTSNETKETTSLQPEETALNLETTGYQAKNTDITEKQLNNKIVEDRITENNTNTQYQPEINSKESTTTDKINPIEEKSPSTELTPIINKTTQTEEYIKKNTKQVEDPTEEKQIIKSVIGTPPQQLTKSQSGNPVVDTDSEANSSITAKSTPVIIIADLLKQSSQNKDGKTIETTSETTPSLRIASRATDSLATTLTAQTGSNVNGLVTVSNPQISETQIDPNQGGNFRLLADYVIDKAVKGGDYFTVQMPEYATYNGDLNYKNSDDKSHTVLATSTGMVIAEGVYDTKTKTLTYTFTDWVNDKQDISGKFDLTQFTDRNTAQKAGTYTLNYDIAGEKYSPQITYAYDAHDHGLYPASVDTMITSVDALQKTNGFQQIVYVNPTDTFLTQAFLTLAPKDVDSNAILDVNTTQLHIYKVPNKAELTDSYAFDASKYQDLAPDFYNSKRVYTNNQGELEVNFGSISDSYVVVVDSKYDPKRSTHLTTRTTLYAKDINGKKASFAFDNSVVTEFSNGTGEGTVQAYKLGDYVWEDINQDGIQETNEKPLAGVKVTLKDKAGQVLQTATTDEYGNYLFNNLVNGDYVVEFETPEGYVATTADAGNDRAKDSNGLVANVTINGADDFTIDSGFYKPVPATYNLGDYVWEDSNKDGIQNSNETGIAGVTVT

SEQ ID NO: 43305 - protein, 229 aa, Staphylococcus simulans ACS-120-V-Sch1
MKEKEKWYQSTWFTILMLLFVFPVGLFLMWKFKKNWKLWVKILITVLVAISVVNMMTNKTPTGNNTSKTKTEQKSDKQEAKKDDKKPETKSSNKMNEVVKVGKMEFNVTNKAIVDQVGDVMTNNAKGKFIVLDITVKNNGDKAVDITDSFFKLLSDKKTFEADGSATITANQAVSPDDLGFIGDKINPESTKNAKLVFDVAPSIAEKDNLVLQVQSGFWGTETAKIELK

SEQ ID NO: 43306 - protein, 467 aa, Staphylococcus simulans ACS-120-V-Sch1
NTVVTFSDDNSITVPKGKDGTSVTVKDSHPDADGNTVIEFSDGSKVTVQRGKDGRDGKDGKSITVTGQTIDPNGNTIVTFSDGNSITVPKGKDGTSVTVKGTSQDPNGNTVIEFSDGSKVTVQRGKDGRDGVDGKSITVTGQTIDPNGNTVVTFSDGNSITVPKGKDGISVTVKGTSQDPNGNTVIEFSDGSRITIQKGNDGRDGRDGRDGRDGRDGRDAQPTQPIYIINNYIDNDNTNVIIFSDGQRVDIPCDANGNAVVIIGYNHDVKGNVILQCADNTRIIVPCRKPDTPKVTIPMIPLVPAQHNTVTPPVPTPVPTPTPVPVPNTVPVPNTVPVPNTVPVPNTVPVQNTVPVPNTVPVPNTTPDTVTPSGNNGTPTSDTHGYTGFINVNNDHGHKFVGKQTTHKVVYHNVEQPQPKVTTKPKQTAKALPETGSDDTAALVYGAIMAGLGATTVLGSRRRKEEE

SEQ ID NO: 43307 - protein, 5081 aa, Staphylococcus simulans ACS-120-V-Sch1
MKKLDFLPNRRNKYSIRKFTVGTASILLGTMLILGVNDEARAAENSTSDSSGSSSSSSTGSGDTSTTESTTETTPTQETQTNTPETTTNTTETAPQVDTSPPQEPAQNTTETTETPATSTPSGETSAPTTDPAPAPDTTTEQDSTPSNQESSTSTPSETPTPSQPSSNESSQTQSTPDTKTTPSTDAPSSSNDTSSDSQTTPSNDTSSESQAAPSNDTSNPDTSTGTSDAPSTTDNNTTNSTANDTSTPNSTNDTTISSIESPTPTLSQDLSQTLDSSTDKESALTDYLATEENLSPEAAQQVVDGMAVDANTATDEEIAGALLTSYLLNTSSAPGSDPVGELPLTTSTQSSTTSSSTSISPMFRMMAFSAYAAPAPATQVSTWDQFIAALNDKTVSNIQLTGNITGTSSPNLQTSTGRSVTIDGGGYTLNTGTNIINAPATSGSWNMTYQNMNITTGNTGGLVNFGASTTTNNTISFNNVKHTGSNLVSSTLANQNVNVNISGNFSSISNDSTLNRSNIGAKNINIAADATVNITRTGLGNALQVVDGGVITTGTNSNITMNVSPTNPWGTTNGTTAFQVGNGGSVLIGDGSTLNITGQNIFDFANDGTLYTGANSTINISQKGNGNIVDMGTGSTFEVGQYSKFIAYSDGHRAGDYSNNNLIGLDGNSQILIDEYATLFLDAKNHQWNPDTKTQVGAYNDLVNINATGTQSALLWVKDNATLDLRTDNRDYYAEVLSIPLGGTSQNRQFIFDNANYINFQKNSIVTSGQSTNGSKPNLIYMDPGSPGYMKWNGSYIVKTWNATHFSDPNQSADADTVWSDVVDLQAAQKGFSTGTPTYNTAESTSASSTPSGTSSKDLSTLNLNTIQRIVLISNNSVNPEAVPAQTTVETIEPSTSYQAVSDPTKPLGTETIVVEGVPGSQTVTTEPGKDTIVNVTQQPTNEVIGVNNVQATTTTIPYNTQYVGVNQPTDYTNVRTQGQAGSTTTTTTYTVDPATGQLSNPVTTTSTVQPVTQVIEKGTVQTTTADVPYETIYRENPNLPQGTQNVVQQGVTGQTQTTTTYTVNQTTGALENPTTSTTTLTQKQDQIIEVGSGVTTSTTSPIPSGTTYVADPNPDAGVGDQTVVTQGQDGVATTVKEPGQEAVTTTTTPAVDEVISVDNVDTNVTPIQYNTVYRYNPDLAVGTTNTLVQEGQNGSTTTTTTYDVDATTGALSNPQTVTNTINPVDQVYEYGPVAGDTVYQVDPNLPYNQTNTVPGTPGDPNDPNNLPTDTIVYVGNVSTSTTPIIHSTEYIGVNEPTTYRNVVAEGSDGSTTTTTTYEVNPQTGELINPQTNTETVPAENRVIEKGTVQVTTAEVPYETTYRENPDLPQGTENVLQEGVVGQTQTTTTYTINSTTGELESPVSNTDTLVQAQDRIIEVGTGTTSVTTTPIPATTVYQANPDKDSGTGDQIVVVEGQDGVSTTVKEPGQEAVTTTTTPAVNEVIGVDNVDSATAPIPYETINRYNPTLPVGSQNVVVQEGQEGTATTIKTYEVDPATGALSNPVTTEEVSPSTPRIVEYGPVEGNTVYQVDPNLPYNQTNTVPGTPGDPNNPNNLPTDTIVYVGNVNTTNETLPYDTQYVGVNQPTDYTNVQTAGQNGVTTTTTTYEVDPNTGTLINPSISTQTTQPVTEVVEKGTVQVATTPVQYETIYQENANLPVGVQNEIQPGVVGEITTTTTYTVNPETGALENPSSTDATTVQKQDRIIEVGTGTTVVTTDPIAPTTVYEANPNPDAGTGDYTVITPGQAGETTTTKEPGQEPVTEITTQPVNEVIGVDNVDTTTETIPYQTETRYNPNLPVGSTDVVAQPGQDGVITTTTTYDVDTTTGQLSNPQVSTETTQPVTQIIEYGPVAGETIYQADPNLPYNETTTVEGTPGDPNDPNNLPTNTVIKVGNTTHELATLPYDTQYVGVSQPTDYTNVRTEGQEGSTATTTTYTVDPDTGALSNPVTSVQTIGPVTQVVEKGTVQTTTADVPYETIYRENPDLPQDTQNVVQQGVVGQTQTTTTYTINPETGALESPTSDTITTIYKQDQIIEVGTGVTTSTTSPILPTTTYQANPDADPGTGDQVILVPGQEGVATTVKEPGKEAVTTTTKEPVNEVVGVDNVDTTTSTTAYDTITRYNPNLPTGSTNVVVQQGQDGVTTTTTTYEVDPTTGQLLNPQVETNTTEPVSQIVEYGPVAGNVVYQPDSNVPYNQTNTIEGTPGDPNDPNNLPTDTVVKVGNVQTDVTTQPYETTYVGVSQSTDYTNVQTQGQDGTTITTTTYQVDPNTGSLSNPVTAVQTIAPVTQVVEKGTVQTTTADVPYETIYRENPYLPQGTQNEVQTGITGQTQTTTTYTVNTQTGALESPVENTTTLVEKQDRIIEVGTGVTTSTTTPIPPETTYQANPDNDPGVGEQTIITQGQSGVSTTVKEPGQEAVTTTTTEPVTEVIGVDNVDVTQQDIPYNTIERYNPNLPVGTTNSVAQEGQTGLKTTTTTYEVDPDTGALLNPAINTTETAPVDRIIEYGPVAGEVIYQPDPSLLVGQQTTTEGVPGDPNDPNNLPTDTVVKVGNVDTATTVLPHDVTYVAVDQPTDYKNVATTGVDGSTTTTTTYQVDPNTGVLSNPTSVNQTTEPVTEVVEIGTQQVTTAEVPYTTIYRENPDLAEGTQNELQAGVIGQTQTTTTYSVNPETGELYNPVANTVTLTEKQDRIVEVGTGVTVTDTTVIPPTTTYEAAPNPDAGVGNTTVITEGVPGESTTTKAPGQDPVTETTTPPVNEVIGVDNVDTTTDTIPFDTQYVAVDQPIGYENVATSGQNGTTTTTTTYQVDPNTGALISPETTTTTEQPVAQVIEIGTKQVTTNDIPFNTTYVDNPNLPVGTENEVQAGIVGQEEITTTYTVNQTTGALENPVSVTTTQVEKQDRIIERGTGVTTTEVTELPPKTIYVADSDSDAGVGGTTVLTPGQAGSTTTTTEPGQTPVTETVPAVDQVVGVDNVDTSTTDVPFETQYVGVNQPVGYENVATTGQNGTETTTTTYDVNPETGALTNPQVSTTSTPATAQVVEIGTTQVETNDVNYETIYRENPDLPAGTQNEIQAGITGQTQTTTTYTVNAQTGALENPTSNTVTTKEVQNRIVEVGTGVTTQTTTPIAPTTSYTANPDTAQPIGEQTVITEGVPGESTTTKAPGQPAVTETTTQPVNEVIGVNNVTQTETDVPYETIIRYNPNLPVGTTDYVAQTGQNGSTISTTTYEVDTNTGALINPNTQTTTIDPINQIVEYGPVAGGTTYQADPTLPAGQTSTVPGQPGDPNDPNNLPTDTVVKVGNVTTETSPVPYNTQYVGVSEPTTYTNVQTPGQNGTETTTTTYTVNPETGALESPATITTTIPSTTEVIEKGTVQVVNTDIPYDTVYRENPDLPAGTQNEIQAGSVGTSQTTTTYQVNGQTGALENPTSETTILSGAQTRIIEVGVGTTVTTTDVIEPKANYVANPDADPGTGDQTVITPGKPGESTTTKAPGQEPVTETTTPAVDEVIGVDNVDTTTQTIPYETIIRYNPDLPVGTVNQVVQEGQDGTTTTTTTYDVDSTTGTLSNPQVTQSTTAPINKIVEYGPVEGTIVYQPDANLPYGETETIPGTPGDPNDPNNLPTETVVKVGNQVTTTDALPYDTQYVPTTEPVGYENVKVAGQDGTSTTTTVYDVDPTTGTLSNPAVTTNTTPAVTQVVEKGTTQVTTSAVPYETVYVENPNLPEGAQNVLQEGSAGQTQTTTVYSLNAETGALENPVSSTVTTQEAINRIIEVGTGVTTTTTTPIAPTTSYEANPDYTQPVGTQTVTVPGQAGESTTTKAPGQEAVTETTIPAVNEIIGVNNVERTETTIPYETIVRYNPSLPVGTTDYVAQEGTNGTTTTTTTYEVDNQTGALTNPQTQTTTVDAVNRIVEYGPVEGGIIYQPDATLPAGQTSTTPGTPGDPNDPDNLPTDTIVKVGNTTTETTQVPYETKYVGVDAPTTYTNVQTPGQTGTETTTTTYSVNPSTGALSNPQITTTSTPAVDEVIEKGTTQVTTADVPYNVVYKDNPNLPQGTENVLQTGITGQTQTTVTYTVNPQTGELENPLSTDQVLVEKQDLIIEVGVGTTSTTTTEIPPETTYVANPDSDAGTGDTQVVTPGVPGESTTTKTPGQEAVTEVTTPAVNEVIGVDNVDTTTQTIPYETIIRYNPDLPVGTTDYVAQEGQNGVTTTTTTYEVDSQTGALTNPQTETQTTNPVQRIVEYGPVEGGVVYQPDSSVPYGETVTVPGTPGDPNDPNNPPTETVVKVGNMTTDTTPVAYDTQYVPTTQPVGYENITTPGQDGVVTTTTIYQVDKTTGTLINPEVTSIKTPPVTQIVEKGTTQTSTNDVPYETVYIENPNLPQGTQNELQAGVTGQTTTIVTYTLNPQTGALENPTEVTTTDIAKQDRIIEVGSGTTTSTTTPIAPQTSYEANPDVSQPIGTQTVITEGQPGESTTTKEPGQEAVTEVTTPAVNEVIGVNNVEQTTETIPYDTIVRYNPNLPVGTTDHVAQEGQNGVTTKTTTYEVDATTGALINPITNTETTNPVQRIVEYGPAAGQVVFQPDPNLPAGETRTVEGQPGDPNDPDNPPTNTVVYVGNVVTDSTSVPYDTQYISTDEPIGYESVVTPGQDGTTTTTTTYEVDPTTGALVNPATSTETTSPTPQIVAKGTTQTTTNDVPFETIYQENPNLPQGTQNEVQAGITGQTETTTTYTVNQETGALENPSTVTTTVTPAQNRVIEIGVGTTATTTTEIPPSTSYEANPDPSQPIGTQTVTTEGQPGIETTTKVPGQPATSEITTPPVNEVVGVNNVEQTTTPIPFETIIRYNPDLPVGTVNHVAQEGQNGVTTTTTTYEVDKTTGALLNPTTTESVTTPPVDRVIEYGPVAPSTTYRPNPDLPVGETQVIEEGTPGDPNDPNNLPKDRVISVGTKVVTTTDIPYDTIYQDNPNLPAGTEYEVQPGKTGQTQTTTVYGVDPKTGELINPDTTTITLVEKVDRIVERGTGTVPVDPEDPGTTPEEPEQPEDPGTTP

SEQ ID NO: 43308 - protein, 45 aa, Staphylococcus simulans ACS-120-V-Sch1
MRNNKERTVMNHANQKAYQYSIRKFTVGAASIAVGAVIFLGGGQA

SEQ ID NO: 43309 - protein, 193 aa, Staphylococcus simulans ACS-120-V-Sch1
PTEPKVPVEEAPEVPAEPEAETPIEPAPEVIPEAPVEEATPTEPTPEEPVEEPTSTGSETPVEKEPVKETEETSTEISPSKEDTVVESEKEEENDEVTVENNDTSKESTGEVTIQNDTENVKTKSVKKDVQDKKSTTLNSKTFTHKKESKTNKQALPETGNETSSMPLLGSLLTLFGLGFIARRFNKNEKTDK

SEQ ID NO: 43310 - protein, 306 aa, Staphylococcus simulans ACS-120-V-Sch1
ALLAQLQGIDIPEINDANANGTNDIQDQWLNEAEAALKEAISTNNAAHIELEKVLSDHRVQTEEQEALAIVQEKVKTTKELAQSAIAQLPSELKGNLISELNNIENIEIPAVTEDKSTTSLETISNEVVSEKPVTTTTQQEEIHLENADEISLNQMVSETTSSVDLNTESEVKQEVKTEDTNKQQEHTTEEKASSESASIEVEHQTEITQKHQTSKDNNASDESTNEHQDTTRTSDRHMYQNDEERSSQTSNNPTTRTTHPEQTVSSKQQKALPNTGQSQSSSIIVGGLAALIGAAFLVSSRRRKN

SEQ ID NO: 43311 - protein, 548 aa, Staphylococcus simulans ACS-120-V-Sch1
MPRKQQHDVLFDKELRNKYHIRKFSAGIASVLFGTLVYTSLDQQAQAAENTDTAVVNPTTQPETNGDTATAESTKTQTNETVNDSPTPQDTTIQQPSVDNQTSETATKPEPVTAPEVSQPTKTDTTQTDAPKVDTQKATEPSTDAPKEAATTEVKATTVTPSEPAVQPADAEVATRAAATTDTTTTEAPAQPITNTSAPAPAANAHPVEKIQGINEQVYAKEIPVYEKSEAARTARMQRGIYQARESLGLIVPQNKKLYIRQAQGSNEEDLRVDLMTNDRQTVRNATVSRDGSWTQISTTMDSGAFVRIPTGLTKKPVVEYYVEGDAGVTLPTYRKGGDKAAFDADWAARNTSYGYVDGDKIAFLVPNVDRERIANLGKNPGQWGFMNLDDMIGYYEDVINHYDKWVGLNDDINSVHYNVGQKYFTIADAHGPGLAYYSTNNMGSNNPSMSGYLERGWLALHEVGHGYDGAMTYDPKMNLIEIENNILANQYQTTIMGVKDGWAYEGRQESMQKDFHERVMDGRMNFYNAGFRGSLDFMTKMVRLTGI

SEQ ID NO: 43312 - protein, 1001 aa, Staphylococcus simulans ACS-120-V-Sch1
MKKSGNKRLDFLPNIHNKYSIRKFTVGTASILLGTTLLFGASRDAEAAETDAQQAEEPAEHGADQAAPAEAPVVNQETQTQQTTPEVSTAQPANESNQAAATSEAKPSDNTAQVAPTNKESVQAEKVEKAEATSQTESTPKADTTTKETAPSNEVKTTETAQVNTVPESTVDYSSLNDGAKAPVEFVEQYLHSSDKEGLVRNLLSETYKAQDVEGILSKLNVDYNAVSAEDLFQDILRAGIEYANEQTSKYTVYAVRAALDSTDDTVNDPDTTSNLDIPKNASTPEAIGALKASASIDPDRGIIITGYGKTYIGQKDAHYEFIAKPDRAHNLMNFEVKYFTDPVGTGPYHTFDLGGFTFGEGFQLPANQAPIIGTWAVVGTTVPLNNKAEIKFGTIKPGYPAGYALEGRPSINSDVFAKNGYGQIKFSLPVKNWNGDLSINGYLMMYPSGGSYNSTPNPYSTQNYFNKNMEVVLDGNIDFNIKQKVQTIETSIPYGTTYVLTKDVPLGEQVTLKRGIKGVEEKTQTTWMYKNIELGTNITGTRVATPPVDEIVGLGVFDPNANQNATVLPPILDPKLSGTNQVTGETTPNANVTITVGLTQYQTTADGNGKFTQTLNVPLKEGEVISATATLNGKTSLPGKTIVPRDGRTPELAYSSLKTEQNGQPGTLVTITNKATGEKLGEFFVPDGAKGEKGDKGDKGDKGAKGDKGLQGLPGLDGLDGRDGLDGRNGQDGKSVFIRTAVQNPNGDTVITFSDGRVVTIPKGDKGEKGDPGTSITIDKINTLPDGTKEVIFSDGKSIILPKGDKGDKGDKGDSLRVNSYTITPEGTIVKFSDGFEALIPSGPKGDTGATGATGATGAKGEDGKSITITSTEPQANGDIKVNFSDGKSIVVPKGAKGDKGEDAAPLTVVNETKDANGNTVVHFSDGKTATISKGDTGATGAAGKDAAPLTVTGEAKDGQGNTVVSFSDGSHVTISKGDKGDTGAQGAKGDKGDTGATGA

SEQ ID NO: 43313 - protein, 768 aa, Staphylococcus simulans ACS-120-V-Sch1
MIFRKEHSAYRHRHIGGTTMKQPNRRLDFLPNKQNKYSIRKFTVGTASILVGATLMFGLSHDAQAAEEQTSSTDTTQTQSESPNPNSDTTSQPTQETKTTAVVTPPVTTEAPASENTAPHNPELNQTTSEAPTTIEQAPQPEETNPTAKDTTPESTPTIDPTSESTPTIHTRAKRSLDTEPPVEQVEAPVNNETYKGKIIDYNGSNLVKKVANPGQTVAPDYIDFSPKFKDHDSKSYSFLTNKETMTSKKTTTTNGGGIHAYFGDYITLDDNQPEAYVYINNVGTANGHKVDALVHVKMDPPSKKFPTNKRYFFTSGRDMLSMTSQDGGGATANIKFMSNIDKTKLDGFYNKVTNGTSITSVIEELKTLNDKLHPVSGLLNIYDLDDYDRNKEVDVRKSVTFNRNEINELYISSNTLSEATANLELKDNKVIISTGEHPRGAVEDYPNRVTATFKDKSELTYSMTGRNASGTAFHVKGILLVPVQPYTVQVVNPTGNDDAKVTITQYIPTREVHQTATLPSKIEMTAEFPQDIVANVQPNTNYFAATQNNTNKVILTNSNNALSQAAFYDKTYTPSITLKHNLTTEDISTSSEKWTRLKEYYDGNALNVPVKWSFDNGTKHIENLTTDYQTVALKLSDELKKEIDKQIMAEATASIEEAKKAHAQAKATAQTIAADQLVSKNEMDGLQNEIQTATSRKNEAQIKVNQLPERLKATLQQELDQLTEIELPKVNDENNNSISDDQDKLIAEAEQLLKEAQEAESNIRNSK

SEQ ID NO: 43314 - protein, 630 aa, Staphylococcus simulans ACS-120-V-Sch1
MKKQLENHSTLEHKRYLKPLLLTGGLLLTSAYFTHDASAAETQDATPKASVTDTNKTAETTAVAETTTTPATPETPKATTAATTNQQPATTTVTQTQTTSTPSPTTPPQTLEQPKPEGSQTLWDNPDGENYYRIPAIASTGDGHVVAVSDYRYNDAWDLGHHRIDLLVKHSTDNGETWGPETNITKQYSSETVGYGDAAMVADRDSNKVVILSAYGDKGYWHKVPEYVSTRQDPLRIARLVSNDGGYTFEKPQDITQNIYGLNDKWTRLFAASGRIMQSRYVKTGDYYRIYTSILEGQPDGNNNYVLYSDDLGEHWNILGDAHSPVPNGDEAKVEELPNGNVAIFSRTAAGRIVNVFTYDKKDKQFATGTWEAQPEKITLGNGGSTNGETLVVYAKNLKTNQYTHLLLQSLPTIDKSRKGVGIYYKALSASDKTAKDVTSGWDPNHFYLIQKGESAYSTMTVLKNGNIGFLYEDKIFNLGYDIQYLTLNLKTITNGLYEMAYTGLGTQQTPFVIENKAQQNAKETVFKNENVQWLDTTKVLPKEEARVVKEKEITMSQTSYSKENKATSNQNINQPNTTSEKNAAKSEQKAKKANELPNTGEETKRNLFVGLLALVTGLVFVKVRRRNKN

SEQ ID NO: 43315 - protein, 1046 aa, Staphylococcus simulans ACS-120-V-Sch1
MNNQDFFNKRNRYSIRKITVGAASVIVGATLFANANDAQAAENTTSGETTNVTTTTESTPQEQTPTTDTKTQSTTTTETTATQDQTPAQDTSATNTTDAKAEQTVAGEQASTDSTQQSTETTAPKADAPATTETKTPTNETTADTTATEQNATAKEQAPKIDAQTTTDTNTANTTTTEPKTTETNTDQTVDKQTSTTNTSAQQESQSTQDAQPTQENALNASTPVAPVEAPTTGTNETTTTGDTAAQNATAPANETTTQQAQSVEPQQDAQTTAQAPVSDAEQPAYDPNAAQLSDANATTAATVGDTSNTADPADLNKSVQDYSNQKDSSEVLAAPTNTTATRSTEQPTQEGAAQTFALAQAAPTGNNVDGDVTASNIQIGPNSIQANDSESTYMSADLAIADSVQAGDYFNVQFPEYLNYYGNSTPSSSKIPDLMNGTEVVATGAFNPDSNSLTYTFSDYVNNHDNVTGHFEIPLYADRQAAPTDGTYPVETNVAGETYSTDIDINYRTSDSPYPSNVDSFITTTDRNTGEYRQIVYVNPQGKQSYNATVNLYNYWPDTADGTPAQSSAQLNPDVTNFKIYEVRNGEQLNPSFYVDENNPNLVDVTNNPDAIYNFNPQYSVDENGGEVLSLDFQDLTSNGSRYIIVLDSVAQDGSREQIKTRSEMISDATNDGQGHTYYTWDNYNVYNSGSGEADGDDTDADADADADADADADADADADADADADADADADADADSDADADADADADADADADADADADADADADADADADADADADADADADADADADADADADADADADADADADADADADADADADADADADADADADADADADSDADADADADADADADADADADADADADADADADADADADADADADADADADADADADADADADADADADADADADADADADADADADADADADADADADADADADADADADADADADADADADSDYPVEPNEPGNPDEPGHPGTPEQGTTQGSNGEQPAQAEGHGDKELPDTGEENNNKEATLFGGLFAALGSALLFGRRKKNKEQ

SEQ ID NO: 43316 - protein, 348 aa, Staphylococcus simulans ACS-120-V-Sch1
MKKLWLIVISALFLLAGCFGLKSHDQSDETIKKGKATDQMQTFKIGQIVDADGVDVQVIKAEYINNYSDIDAPKNGKALQVTLKFKNNNKPKVVVDSSAFAMTIRGETYPDWVGGNHSEGSFTHQLSHGKTAVESLTFDVPDAKVYTLEMDAQFKKKNVKGKWNIHQAMIKKGDSQNDTNKAAASDTKEKSSKKSSKEKDYPYSADEYNALVDLYNAFTKGERMNHVTRGVTNKEYNDLAARIDKLYDELEAEWDKEYQKQLEREDAEWQKNQDRIDKEFEAEMKRQDEIDAREEAQRQKQEEADQRAYEAEMKRQDEQAAREAQEQAKLDAELQKQEEAADQAMLEE

SEQ ID NO: 43317 - protein, 704 aa, Staphylococcus simulans ACS-120-V-Sch1
TTETTTTDEKGKYEFTGLANGDYKVDFATPEGYTATLVDQGNDALDSDGTSTTVKINNADNYTIDSGFYKPTVEPTPVPGTYSIGDKVWEDSSKDGVQNSNEKGISGVTVTLTKPDGSTETTVTDDNGIYHFTGLPNGEYTVTFDTPKGYEPTKVNVGDKALDSDGQTVKVVVDNADDFTIDSGFYKPTVEPTPVPATYNLGDYVWEDSNKDGIQNSNEKGIAGVTVTLTKPDGTTESVVTDAEGKYNFTGLENGEYTVKFTAPEGYTATKVNVGDQALDSNGLETKVVINNADNYTIDSGFYKPVVEPTPVPATYTIGDKVWEDSNKDGVQNSNEKGILGVTVTLTKPDGSTETTVTDENGIYQFTGLYNGEYTVTFDTPKGYEATKVNVGDKALDSDGQTVKVLVDNADDFTIDSGFYKPVVEPTPVPATYTIGDKVWEDSNKDGVQNSNEKGISGVTVTLTKPDGSTETTVTDENGIYQFTGLYNGEYTVTFDTPKGYEATKVNVGDKALDSDGQTVKVVVDNADDFTIDSGFYKPVVEPEKPITPEKPEEPKVPEKPEKPEVPEVPEKPEVPEVPEKPEVPEKPEVPEVPEKPEVPEKPEVPNTPEKPEKPNKPEVPTTPEQPSEPGQPTPPKAPKGDVAPHKVVKSEKQPEKAPKVSKDKALPETGEEGTNAGLIGTLFAALGSVFLFNRRKKETKDHK

SEQ ID NO: 43318 - protein, 105 aa, Staphylococcus simulans ACS-120-V-Sch1
PGTPEKPEVPTTPEEPGTPEKPEVPTTPEEPTAPAVTPAPSVEQPAVEKQEKPSEEASSKEKKEALPDTGETESTNNAPLFGGLFAALGSILLFGRRRKDNKDKQ

SEQ ID NO: 43319 - protein, 1149 aa, Staphylococcus simulans ACS-120-V-Sch1
MRNNSHSRGFDARRQNKYSIRRFTVGTASIIVGATLLFGIGNEARAAEGTTDSTGNQTSGSSTSDPASQPTEDAAPTQETAPTQETQTNTTDQSTDQSVDQPVESTTPQTDTKTTDAPTTGETVTPEQNTTTASDAPQQETSSQTASSTDTSSTTKDTSSQSAPESADTTTSTTQEKSTSDTSSQSSTSDKVDAPTTAAQEPSSTTQEKSADTSSTSNTTSAQTAEEPVTTQGSTDQTVDKSTVEPSAEQNTVSSTEPTQQVIAAADSNTTTDAGTTQDTSLQSSDLAAQAGVTSADSPELATYKLLQQSSDNKDANTIQTTAETTPMSRSFSLMSASPTTFTTLAAATGTNVNDLVTISNPTISTEQIDPNQSDNFRLNADYTVNGTVQGGDYFTVQMPTYANMDGELDYTNTNNQFTTELLSPSGYVVANGVYDTTTKTLTYTFTDWVNDKEDVSGSFSLAQFADRNTAKDYGTYPLTYNLAGETFNTQITYAYDSHEHGVYPAYVDSMITNVDATNTTNDFTEVVYVNPTDLNLSSAALVMAPKDGNSNALIGFDYTTFHIYEVPDPSQLPDSYDFEAAGYQDLAQSFQNNGSIYTNANGDMIINFGAIDNPYVVVMDSQFDPTYSSNLTTRATLYATDQSGYTASYFFDNSFVIENSSGTGDGTLETYRLGDYVWEDTNQNGIQDSGETPISNVLVTLKDANGNIINTAVTDRYGNYLFSDLNNGDYTVEFSTPEGYVPTTQNAGTDSTVDSNGLVVPVTINGADNLTIDSGFYKPVAATYNLGDYVWEDSNKDGIQNSNEVGIEGVTVTLTKPDGTTETTVTGADGKYEFTGLENGEYTVNFSTPAGYEATLVNQGDLTALDSNGTTTTVVINNADDYTIDSGFFKPVVEPEPVPATYNLGDYVWEDSNKDGIQNSNEVGIEGVTVTLTKPDGSTVTTVTDANGKYVFTGLENGDYTVDFTAPEGYEATLVNVGDDALDSDGASTTVTINNADNYTIDSGFFKPAVEEPTPVPATYNLGDYVWEDSNKDGIQNSNEVGIEGVTVTLTKPDGTTETAVTDANGKYEFTGLENGDYTVDFTAPEGYEATLVNVGDDALDSDGASTTVTINNADNYTIDSGFYKPVQETPQEPATYTVGDKVWEDTN

SEQ ID NO: 43320 - protein, 881 aa, Staphylococcus simulans ACS-120-V-Sch1
MKKKQLFSLRKLTVGIASVSLGTVVFLSGAQAVDAQANAQDATTITQNAYNVVNNLPNISDKTKDAYIAKITAAAGNNKLTDVEGIVNSAKAEDAQVATAKKVAAEQDAKAVNQQVELAKKVAIETAKKDHAQKIANAKAEIYKLENLSNFTKARYSAKITKAATDEIAGLVQNAKAEDAKIATAKNAGKEQAKADTAAKDKAVKALNQKTADAYQVINSLKNITDKQQLSFLHQVEVDSGTNNGERIDAIVADAKQLDAQFAYDKEQKAKAEQKAARELNTLTQVAYNTVNGLHNLTDQQKDAFNKQILQDSGNNNGHNINNIVANAKALDEQNGNAKHAREAGASTVEQKDKAVRELNTLTSVAYNTVNNLPNLTDAQKDDFNHQILVDSGNNNGQKINDIVAAAKQKDAESAQAKHVREAAANTNLPADVAKKVKAAHNTVEALKNLKPEQKAAAHRKLNEVARTDAKAIDTVVAQAKELNANQAPGNNERAKQKIETAQKAHAQRIANAQAEVNRLKNVSKNTKAEYNEKISRAATDEIPALVKEVKALDAAKQPAIAKKEIAAAQKAHAEQIKESQALVNKLENLSKEAKDEYNSRIAKAATNEVEAIVNEAQAEDTHAATAKKEITAAKNAHEAEIAQAQAVAKQKIETAQKAHAQLLADAQALVNKLENLSKEAKDEYNSRIAKAATDEVEAIVNEAQAEDAHAAAAKKEITTAQKAHAKQIADAQALVNKLDKLSKDAKASYNQQIAQAATDEVAAIVQKAQAENAKQAPVNKEVKPAQKATTTPGQANKAGQTTTAQNNGKVVTGQKAAQKAGQTTATTNKAAAQQKAKDAKKQLPATGEQDQVLFGLLSGSLFASAGTLFLLNARRRKENE

SEQ ID NO: 43321 - protein, 523 aa, Staphylococcus simulans ACS-120-V-Sch1
MKKKQLFSLRKLSVGIASVSLGTLVFLGGGQTVSAETQDLNQKTQEAYNTINNLPSLTDAEKDAYNQQILEQSGQNNSNFDAILAEAQKDNTQAAEDINYASQDAYNIINNLPSLTDAQKDAYNQQILESAGANNTDFDKILDEAQAANDQAAQDINQASLDAYNTINNLPSLTDAQKDAYNQQILESAGANNTNFDAILAEAQKVNDQTAQDINQASQEAYNTINNLPNLTDAQKDAYNQRILEVAGTNSTDFDAILSEAKAADAQAAKETPEALEALNKATQDAYNTINNLPNLTDAQKDDFNHQILVESGQNSTEKFEAILAEAKALDAKQAPVEEDKADDKEKQEDSKSEDKATEEEAKPEDNKSEEKADQKEQPKEDAKTEGKVKEEKTPENKTDEKAVEKDIKKAADEKTSVKERTKAAHDAVNKLENLTQKQKDAYIAQIDKSAKEDKGAQFEAILTEAKAEDAKVAKENAKPKADAKELPATGESDEVLFGLLSGSLFASAGTLFLLNARRKESK

SEQ ID NO: 43322 - protein, 77 aa, Staphylococcus sp. OJ82
MTSFDPNNSLDSTNTLESANDSDSENEANQNEKDKDKDSELPNTGDDTTKNGLLAGILGLGGLALLRRRRKKETDNN

SEQ ID NO: 43323 - protein, 434 aa, Staphylococcus sp. OJ82; identical to SEQ ID NO: 42961

SEQ ID NO: 43324 - protein, 290 aa, Staphylococcus sp. OJ82
MKKLDTWLEKHNLRNIPTFIVAVAFVIFVIMIIAFLNHNDENSSTIYITEDAELRTGPNAVYPEINSIKKGQNFHKIGESGKWIEVESGNNEKGWVAGWHTNLNIQADTNKNAKPLKDKIIVLDPGHGGRDQGASSNTNKHSKEKVYTLKTAKELKALLEKEGATVNMTRSSDEYVSLSDRNIKGDAYISIHNDSLKSAKANGSTVYWFKKNQKALAETLSASLQKKALLTNKGARQENFQVLRQTDVPAVLLELGYISNPTDEDMIRDQLHRQIVEKAVVDGLRAYFSE

SEQ ID NO: 43325 - protein, 917 aa, Staphylococcus sp. OJ82
MGVGVGSVLIGLTIFATSGNVASADERQNKGDSFESVVSDKSVGEIGSPIQNDTEKPSEDEKGTIETAQQEIENVKAENTSEVSEEKSELSNESKEEVTQEEITTSTEDVKSTEEVSQETPKALPEEDTETSPEDEKDTEEVTQEDTETLPEDEKDTEEITKEDSEISPEDEKEIIEPAEEGSKSEDEDIAETNATLQRRADVNNQATEGIQTYAALADVTLLDNMELTATHNNGVLNLQLEGRPLVGLGVGNTYPTFQLSPQFRDLMADPNFLNAIELDYDLPGLLGVLRNTGTLQGNELTIDPNTGVVYGIVENLVNLGVGSRVTYNLMIDLNQLTENGMLPESDLPGRQEYNFSSAAGSGLINVDLLANSGNDTSIVIENEEDSESISESESLSTSESLSESESLSDSESLSESESLSASESLSESESLSTSESLSEVESESLSESESLSASESLSDSESMSTSESLSESESLSTSESLSESESLSTSESLSESESLSTSESLSESESLSTSESLSESESLSTSESLSESESLSTSESLSESESLSTSESLSESESLSTSESLSESESLSTSESLSESESLSTSESLSESESLSTSESLSESESLSTSESLSESESLSTSESLSESESLSTSESLSESESLSTSESLSESESLSTSESLSESESMSTSESLSESESLSTSESLSESESLSTSESLSDSESLSTSESLSESESLSTSESLSDSESLSTSESLSESESLSTSESLSDSESLSTSESLSESESLSTSESLSESESLSTSESLSEVESESMSTSESLSESGSMTSSDPNNSLDSTNTVEASNNLSGSTNSAEATNNSSSSIDTAEASNNSSDSTNTLESANDSDSENEANQNDKDKDKDSELPDTGDDTTKNGLLAGILGLGGLALLRRRRKKETDNN

SEQ ID NO: 43326 - protein, 236 aa, Staphylococcus sp. OJ82; identical to SEQ ID NO: 42962

SEQ ID NO: 43327 - protein, 130 aa, Staphylococcus sp. OJ82
MFNRIKDSMNFQSRTEGNEGTESNEGTESNEETVIVQPGQTLSEIAESNGMTPEALAEVNDLNVNDVIYPGEKLYITEEASNTESNGSTEHMDKLPETGENDSMLGTSLFGGLALSLGALLLGTRRKKQN

SEQ ID NO: 43328 - protein, 226 aa, Staphylococcus sp. OJ82; identical to SEQ ID NO: 42964

SEQ ID NO: 43329 - protein, 446 aa, Staphylococcus sp. OJ82
MFNNTKRNTIYSIRKGMMGTASVTIGTCLLLGMSNQASADEHSHVKNGSETTTAQDQTSSQNHTLESPKSTPTDNHNLNNNQAANIHNQNEGTTEEPKEETTDTNKQDIKNENQSPNTQSSLNNSSDTQKPEQPTESDASEEQTIDNNAKESEESITEHDTNKDEFAEQNTQKSQQHELLKEKDKKKDSNVENSKYDQSPKSSSSEAKQEQVQKNDESKQSIDQTKNSKTSTEHSKTPLNESEAPTDNSNTPNEPDKSTKNSNTSADNATSTTQKQHDPANKSVNKTEDSIKPTHKIEDASTESQFASEPLNNNNENSDAISSNSTSTKKLETLTNEERATLLKAIQHDTQEQDKQPKAVLQMASAQNPTIRNTRNASKDSTSLNINHTGRYDSGAGFDKGGTEIVKYNPKNGYAYSINGDKEALDILDIKNTKNKEIQLVNRIYL

SEQ ID NO: 43330 - protein, 218 aa, Staphylococcus sp. OJ82; identical to SEQ ID NO: 42960

SEQ ID NO: 43331 - protein, 87 aa, Staphylococcus sp. OJ82
MSQENSTIEKTNSNSTVNKNTTNSSINKGESKRAHSNKLNSENELPETGQDETRNSTLFGTLIAGLGGLLLLVMRRRKKEEDENKMS

SEQ ID NO: 43332 - protein, 2386 aa, Staphylococcus sp. OJ82
MKNNHDLTPNRMNKYAIRKLSVGTASLLVGSVLVFGISNDANAAENDLSKDSKALSTNVNEEDNHLVDTEKANSNEQNPVNDFSESHDIHNDNLNTSDSASEQSVVENKPTVNNTAEIDTSNKEREVAVNTTKNKVTDNKENNNNTSNVIEKEIEESKANKTNEENSEIVKTENKMKAAHNFDNSSQKFENRETDDIAEKATINQSEAQNREDINHEENNTSNKLEAKDEVNTQSENIKPASEHNVPDRNNTESVLNTKESNNAVAKVRKRRSIINRKTSSKAMTEDSALEALEYSENYTFQTLIFDPESLAKNSVLNSKTIPFEIHSYMTGANSGDRYKINLQLDPIIANHVTRITVNPAGRTSPVQFVRLSNKQGRLTNIWQVNFIRANNGLFGGGEILSQYTASNGVIYLDTTVKNILNSMNNKHDKLNYLIYVKDNSENKKIQTSETSGYFLTAAEREINNIPPSQSTNANNSFKASSGTVQYDPKIGNFGGAIIDQQILKNGIFNYRGKIMDAGLYKQWTYHYQIDPALLPYIGSIELHKQDFRGLYGFDKKYYAANKVATLRVDSKGRGSITHSDLNQLIEFNNALPETVGIRIVIKYNQSPNNILTRNASYDQNGNLISSTTQVKEDFAFYGYFTDRNGGIINNTFGSATYYIQDLDKDGLTDNYEIHNSHSDPFNGDTDRDGKNDGDEVLRYQTSPLVGKPIVNDITTEDTIIRGDVPLDKSAARQKVKILNPNGNVIKQGALNKNGTFSFNVSKLPPGKYKVAIESPNYRNAEVNTFNVIDMKALLKPAIAPVNDQNTNLQVKGVEGSTVVVKDNNNNVIGTVVLGKGETTKSLQLNQPLKAGTVLTATATKNGKTSYASDPVTVTDVTAPIAPTVTEVTSESAQVTGTGEPGSTITVKLPDGSVATGTADNQGNYAIDLPIDKKLNGNEELVVTSTDGAGNVSPETRATVKDVTAPSAPTVNEVTSEGTQVTGSGEPGSTITVKLPDGSVATGTADNQGNYAIDIPTNVDLVGNEEVVVTSTDGAGNVSPETRVIVKDTTEPVAPMVSEVTSEGTQVTGSGEPGSTITVKLPDGSVATGTADNQGNYAIDIPTNVDLVGNEEVVVTSTDVAGNVSPETRVIVKDTTAPVAPMVNEVTSEGTQVTGTGEVGSTITVKFPDGSVVTGTVNDQGNYAIDIPTTVDLVGKEELVVTSTDGAGNVSPETRETVKDVTVPVAPTVSEVTSEDSQVTGTGEAGSTITVKFPDGSVVTGTVDDQGNYAIDIPINVDLVGNEELVVTSTDGAGNVSPETKVTVTDATSPNAPAVNEVTSESTRVTGTGESGSTITVKFPDGSVITGTVDSQGNYAIDIPTNVDLVGNEELVITSTDGAGNVSPETKVTVTDATAPVAPTVNEVTSEVTQVTGTGEAGSTITVKFPDGSVVTGTVDNQGNYVIDLPADKKLNGSEELVITATDDSGNVSPETRLTVKDTTTPAAPTVNEVTSEGAQVTGTGEAGSTITVKFPDGSTVTGTVDNQGNYAIDLPIDKKLNGNEELVVTSTDDSGNVSPETRLTVKDTTTPDAPTVNEVTSEVTQVTGTGEAGSTITVKFPDGSVVTGTADNQGNYAIDLPVDKKLNGNEELVVTSTDDSGNVSPETKVTVIDATVPNAPTVTEVTSEDTQVTGSGEAGSTITVKFPDGSVVTGTADNQGNYLIDLPVDKKLNGNEELVVTSTDDSGNVSPETKVTVKDVTAPDAPTVSEVTSESTQVIGTGEAGSTITVKFPDGSVVTGTVDSQGNYAIDLPIDKKLNGNEELVVTSTDGAGNVSSETKVTVTDATAPAVPTINEVTSEDSQVSGTGEPGSTITVKFPDGSVVTGVADDKGNYAIDLPIDKKLKGNEELVVTSTDASGNVSAETKVTVTDVTAPNAPAVNEVTSESTQVTGTGEPGSTITVKFPDGSVVTSTADNQGNYAIDLPIDKKLNGNEELVVTSTDGAGNVSAETRLTVKDTTAPDAPTVNEVTSEGTQVTGTGEPGSTITVKFPDGSVVTGVADDKGNYAIDLPIDKKLKGNEELVVTSTDGAGNVSREAKVKVKDTTAPAAPTVNEVTSESTQVTGTGKPGSTIIVKFPDGSVIIGTVDNQGNYVIDLPVDKKLDGNEELVITSTDSSGNVSRETKVTVKDATAPAAPTVNKVTSGDTKVTGTGEPGSTITVKFPNGTIVTGRADNQGNYVINIPSIIDLNPGDTIQVSSIDKSGNMSGTTTIIVNNSSVSITKQANDHDKSSNNFDLNSQLGLNGIEGEDGKEHTNLNSNIKHSDDSVNHKSGTDIASKGDVIQTNDEKGTISNMNNDKNNLDKGNNKHVDKLPTTGENENQNKGLFSSLLAMIGAFILIGRRRKNTEEH

SEQ ID NO: 43333 - protein, 747 aa, Staphylococcus sp. WL1
MKNRENKYSIRKFSVGTSSILIAALLFIGGGSAQAAENQDKGNVDSEALQAQSIGEQQGNDVKNEQTNQSSELKKQNDSVEAQNDNQQDVTPTSLHKETSEKDTTQTSQDNTEEKQPKDATVESDQSVDQVQRDVKTAPKEKTTEEQATKSVEKPDTTTPNQKDKANGKAVKEETPTPSPKAQDKASSTQTHQHDVDPEFNSRHKASQVDPEFSHKQAQKKADVDSEFNKNHKAQQVDPDFSRRHATEKATHATVNKEKSDATINQKDQHKVTAQSVDQTATAPNQTDSSQKSKQKQSVSLDQLEKDSPLLSKDNPSKKDKEQNDGLQALKSNSVATLNNQSKNKVAVADKDQTNKKAKQQQYKNHDPIILVHGFNGFTDDINPAVLSHYWGGDKMNIRQDLEENGYKSYEASISAFGSNYDRAVELYYYIKGGRVDYGAAHAAKYGHERYGKTYEGVYKDWKPGQKVHLVGHSMGGQTIRQLEELLRNGNQEEIEYQKKHGGTISPLFKGNNDNMVSSITTLGTPHNGTHASDLLGNEAVVRQVVYDIGKAFGNKDSRVDFGLSQWGLKQKPNESYIDYAKRVKNSNLWKSQDNGFYDLTRDGATDLNRKTSLNPNIVYKTYTGEATHPSLFGRQKADLNMFLPFILTGNVIGKANEKEWRENDGLVSVISSQHPFNQKYTQATDKNQKGIWQVTPTKHDWDHVDFVGQDSSDTVRTREELQQFWHGLADDLVQSEKLTSEQKAQA

SEQ ID NO: 43334 - protein, 1674 aa, Staphylococcus staphylolyticus
MRNKQGLLPNKLNKYSIRKFTVGTAPLLVGATLVFGIGSEAQAAELDTITKEDVKSRDKGEALDIKNIKESEKDVTTEDDNNAQVQNSAQTVDKSENSNDTAVESTNDSVKTDETKETSENKSAQDDDNIKEDSNTQEESTNTSSQSSEVPQTKKDTNETSETAIDEDASIKEQNNKDNDTAQDDDNIKEDSSTQEESTNTSSQSSEDSQTKKEQPDKSSNSIKEPDKQQEEVAKEEKATTEIADKNKELELKNNKTDKNEESELESNLSSSENKKDTVESFLNSQLSDSETKKIMENANIDYDKATDEEINTEILRASLIEMANNKKKTETLATPQRTMFRAMATPTALRAAVYPDEELPKSLGYTDDYTFASMLFDPGKLDSDDALNSNIIPFDLHSYMSGANSGNRYKIDLKLDPIIAEHVTKISANPSGSNKPVEFVRIKDENGNLTDTWEVNFIRANDGLFGGAEILSQYTAKNGKIELDDTVGNIVSNAGNLSNNKLNYQVFVRDSKENKIVRTSESSGYFLTKADNDLVNLENNVSTENNNAFKASSGSATYNKDVGEFGGILIDQQIMKNGIFSYSKTKANQWSYNYQIDKDLLPYIEGVELHQYEYKGLEGFDKNYDAKNKVANLTIDEVGNGTITSDNLNKLIEFNNALPETVGVRVVLKLNQSVNNILTKDAKYDSEGNLIRETIKQKEDFTFAGYLTDSKGALINNTLGTSTLALQDYDKDGLLDRYERQVSLSDAESEDTDGDGKNDGDEVINYKTSPLVGKPHAAHITTEDTDGSGSVPLKEGAATQTAKVINAEGTTVGTTTVNSDGTFSVSIPNSPEGTYTIAIDSPNYDNDEVNTFEIVDNSKLPAPSINPVDDNDQQIVVNGTSGSTVTVTDSNNNVLGTVTIPADDTSAAINVDTPLEAGTVLTSTASKDGKTSDVSDQITVTDATAPDAPTLDEVNTDATQVTGQAEPGSTVTVAFPGGGKASTTADDAGNFIVDIPSEVNLEGGETFTATATDKTGNESEPSTTTVVDTTAPDAPTVNDVTSNDKVINGTAEPGSTVKLTFPDGTTATGTADDQGNYTIDIPSNVDLNGGEELQVTATDKDGNTSEPSSANVTDTTAPDAPTVNDVTSDATQVTGQAEPGSTVTVTFPDGTTATGTADDQGNYTIDIPSNVDLNGGEELQVTATDKDGNTSEPSSANVTDTTAPDAPTVNDVTSDATQVTGQAEPGSTVTVTFPDGTTATGTADDQGNYTIDIPSNVDLNGGEELQVTATDKDGNTSEPSSANVTDTTAPDAPTVNDVTSDATQVTGQAEPGSTVTVTFPDGTTATGTADDQGNYTIDIPSNVDLNGGEELQVTATDKDGNTSEPSSANVTDTTAPDAPTVNDVTSDATQVTGQAEPGSTVTVTFPDGTTATGTADDQGNYTIDIPSNVDLNGGEELQVTATDKDGNTSEPSSANVTDTTAPDAPTVNDVTSDATQVTGQAEPGSTVTVTFPDGTTATGTADDQGNYTIDIPSNVDLNGGEELQVTATDKDGNTSESTNTTVIDSDDNSDNGNNSGAGDNSDSDNNSGNGNNSNAGDNSDSDNNSDSGDNSNAGDNSDSDNNSDSEDNSSSNKDSINQDSNVNSNDSKHDKQNELPETGEKEVRNGTLFGTLFAGLGSLLLFTKRRRKENDKK

SEQ ID NO: 43335 - protein, 480 aa, Staphylococcus staphylolyticus
MKKTKNNYYTTPLAIGLSTFALASIVYGGIQNETHASEKSNMDVSKKVAEVETSKPPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKAPVENTAEVETSKALVQNRTALRAATHEHSAQWLNNYKKGYGYGPYPLGINGGIHYGVDFFMNIGTPVKAISSGKIVEAGWSNYGGGNQIGLIENDGVHRQWYMHLSKYNVKVGDYVKAGQIIGWSGSTGYSTAPHLHFQRMVNSFSNSTAQDPMPFLKSAGYGKAGGTVTPTPNTGWKTNKYGTLYKSESASFTPNTDIITRTTGPFRSMPQSGVLKAGQTIHYDEVMKQDGHVWVGYTGNSGQRIYLPVRTWNKSTNTLGVLWGTIK

SEQ ID NO: 43336 - protein, 716 aa, Staphylococcus warneri
MFKDYMIKLINSYFFESISEGNTYRGDFLKNNNSKRQFSIRKFTIGVVSIVAGITFFVSEHDVQAAEQQSSHLSQESVLSHSKPSDQDANVSSKESEIDKNINKVDDAQSYSQQNEQQSSKAENKEIQNSTQAEQVEKQEQPASNQTANHSSKESSINNQESHNKQQPSDDKTPNIKPEKIEKVDNHKRIQDQYQDKNKQVDNNQSNNSQLNQKEHPNSSNNKQQKQRLDVKPQNDNQQLQSRNDVKEKLDNQPIEQKDTKLQSNNKSKDNTTSVKSHSQQHKPHSLKTQSHLTPGQKVNTNISTNPTQQQTTNQNIKPKNTDEATIKSNQYKNKYPVVLVHGFLGLVGDNAPALYPNYWGGTKFPVKKRLEKLGYDVHEASVGAFSNNYDRAVELYHYIKGGKVDYGAAHAAKTGHDRYGKFYQGIMPDWEPGKKIHLIGHSMGGQTIRLLEHFLRHGNQEEIDYQKAHGGEISPLFTGGKDNMISSITTLATPHNGTPAADKLGNTDFVKGVFNRIGRLSGNKYSHIDLGFSQWGFKQRPDESYIDYVKRVANSKIWKTQDSAVYDLTTEGSEKLNQMTSINPNIVYTSYTGLDTHTGPLGNENPNIRQFFLFDLTSRLIGRDDNVNVRKNDGIVPVSSSLFPTNQAAKTVGMTSPTTDKGIWQVKPVMNGWDHLDFVGLDATDYKRIGEELSQFYLGIINNLIRIEDIDGIKH

SEQ ID NO: 43337 - protein, 25 aa, Staphylococcus warneri
MAADIISTIGDLVKLIINTVKKFQK

SEQ ID NO: 43338 - protein, 25 aa, Staphylococcus warneri
MTADIISTIGDFVKWILDTVKKFTK

SEQ ID NO: 43339 - protein, 736 aa, Staphylococcus warneri
MKNRKNSYSIRKLSVGASSIIVASMLFVGAESAQAAETESQDQTTVQNVKETTESSNSNQTQQQPLESTKAKDSDTNNTNVERPELNWTQTSNQDTDKMQDTSTNQTNENSKHIIDKTNDVSHETTKTNDTDQTSHLQLTQDKSEQSPAVESNEKSTSNDKSTPTKQEPNNTKQDIDETSKPNEDSKLVPSKSVITSKADKQEQSSKKPVKDNAKKDKQVSKDSSLEKQGTQEIPQTDSHKDVNVTPSKSSSEQQLSTTQHITAKDSSASQEVPVHSLDSSKQDHTTSTESHINLDNLDKQATKDRTPTDNGDDQSKDGLNTLTKNAVAIHNNKSKAQATQPTKDQTNKVAPQQQYKNHDPIILVHGFNGFTADNGPGLGDSNYWGGERLNITQEARAKGYNVSEASVSALGSNYDRAVELYYYIKGGTVDYGAAHAAKYGHERYGKSYAGAYRDWKPGQKIHLIGHSMGGQTVRLLEEMLRNGNPEEIEYQKQHGGEISPLYKGGQDNMISSITTLASPHNGTHASDLLGNEAIVRQAVYDFAKSQGNKFSRADLGLTQWGLKQRPDETYIDYVKRVENSSLWKTKDNGFYDLTTEGAQELNNHTSLNPKIVYKTYTGESSDPDKNGIHHRNSHMNIKYLPTTNVIGKLDDQAWDENDGLVSVVSAQHPSNQKYVDATDQIQKGVWQVTPVQHDWDHGDFVGTQKDENGISIEQFQGFWDNLLNDAVRNEKVTDQ

SEQ ID NO: 43340 - protein, 711 aa, Staphylococcus warneri
  MOD_RES (162)..(162): Any amino acid
MIKLINSYFFESISEGNTYRGDFLKNNNSKRQFSIRKFTIGVVSIVAGITFFVSEHDVQAAEQQSSHLSQESVLSHSKPSDQDANVSSKESEIDKNINKVDDAQSYSQQNEQQSSKAENKEIQKLTQAEQVEKQEQPASNQTANHSSKGPSINNQESHNKQXPSDDKTPNTEPEKIEKVDNHKRIQDQYQDKNKKVDNKQSNNSQLNQKEHPNSSNNKQQKQRLDVKPQKDNQQLQSRNDVKEKLDNQPIEQKDTKQQSNNKSKDNTTSVKSHSQQHKPHSLKTQSHSTPGQKVNTNISTKPTQQQTTNQNIKPKNTDEATIKSNQYKNKYPVVLVHGFLGLVGDNAPALYPNYWGGTKFPVKKRLEKLGYDVHEASVGAFSSNYDRAVELYHYIKGGKVDYGAAHAAKTGHDRYGKFYQGIMPDWEPGKKIHLIGHSMGGQTIRLLEHFLRHGNQEEIDYQKAHGGEISPLFTGGKDNMISSITTLATPHNGTPAADKLGNTDFVKGVFNRIGRLSGNKYSHIDLGFSQWGFKQRPDESYIDYVKRVANSKIWKTQDSAVYDLTTEGSEKLNQMTSLNPNIVYTSYTGLDTHTGPLGNENPNIRQFFLFDLTSRLIGRDDNVNVRKNDGIVPVSSSLFPTNQAAKTVGMTSPTTDKGIWQVKPVMNGWDHLDFVGLDATDYKRIGEELSQFYLGIINNLIRIEDIDGIKH

SEQ ID NO: 43341 - protein, 746 aa, Staphylococcus warneri
MKNRENKYSIRKFSVGTSSILIAALLFIGGGSAQAAENQDKGNVDSEAQQAQSIGEQQGNDVKNEQTNQSSELKERNDSVEAQNDNQQDATPTSLHKETSEKDTTQTSQDNTEEKQTKDATVETEQSANQVQQDVKTTKEKTTEDQATKSVEKSDATTPNQKDKADGKATKEETPTTSPKAQDKASSTQTHQHDVDPEFNSKHKASQVDPEFSHKQAQKKADVDSEFNKNHKAQQVDPDFSRRHATEKATHATVNKEKADATINQKDQQKVTAQSVDQKATAPKQTDSSQKSKQKQPVSLEQLEKDSPLLSKDNPSKKDKEQKDGLQALKSNSVATLNNQSKNKVAVADKDQTNKKAKQQQYKNHDPIILVHGFNGFTDDINPAVLSHYWGGDKMNIRQDLEENGYKSYEASISAFGSNYDRAVELYYYIKGGRVDYGAAHAAKYGHERYGKTYEGVYKDWKPGQKVHLVGHSMGGQTIRQLEELLRNGNQEEIEYQKKHGGTISPLFKGNNDNMVSSITTLGTPHNGTHASDVLGNEAVVRQVVYDIGKAFGNKDSRVDFGLSQWGLKQKPNESYIDYAKRVKNSKLWKSQDNGFYDLTRDGATDLNRKTSLNPNIVYKTYTGEATHPSLFGRQKADLNMFLPFILTGNVIGKANEKEWRENDGLVSVISSQHPFNQKYTQATDKNQKGIWQVTPTKHDWDHVDFVGQDSSDTVRTREELQQFWHGLADDLVQSEKLTSEQKAQA

SEQ ID NO: 43342 - protein, 177 aa, Staphylococcus warneri
MKTKQLLSTTAIAGTLLLSGLHAPQAKAESNINGSNAVDIIQQVDKQHGNQPDLIRYGQPKDHGDYYEVTTNNKSGVGGAGITRLYKDGTVKHSTDSSGQDFKTFGHYEDASYQSSSHDQNTPQASTTQHTEQTQHDTTDQTLPETGQSHTGITTMISIIALIAGIGFIARRASHQA

SEQ ID NO: 43343 - protein, 732 aa, Staphylococcus warneri
MKNRKNSYSIRKLSVGASSIIVASMLFVGAESAQAAETESQDQTTVQNVKETTESSNSNQTQQQPSEPTKAKDSDTNNTNVERPESNSTQTSNQDTDKMQDTSTNQTNENSKHIIDKTNDVSHETTKTNDTDQTSSQDNSEQSLEVDSNEAPASNDKSTPTKQEPTNSKQDIDETSKPNEDSKLVPSKSNITSKADKQEQSSKEPVEDNAQKDKHVSQEDSSLEKQGTQEVPQTDTHKDVNVTPSKSSSEQQLSTTQHITAKDSSASQEVPVHSLDSSKQDHTTSTESHINLDNLDKQATKDRTPTDNGDDQSKDGLNTLTKNAVAIYNNKSKAQATQPTKDQTNKVAPQQQYKNHDPIILVHGFNGFTADNGPGLGDSNYWGGERLNITQEARAKGYNVSEASVSALGSNYDRAVELYYYIKGGTVDYGAAHAAKYGHERYGKSYAGAYRDWKPGQKIHLIGHSMGGQTVRLLEEMLRNGNPEEIEYQKQHGGEISPLYKGGQDNMISSITTLASPHNGTHASDLLGNEAIVRQAVYDFAKSQGNKFSRADLGLTQWGLKQRPDETYIDYVKRVENSNLWKTKDNGFYDLTTEGAQELNNHTSLNPNIVYKTYTGESSDPDKKGIHHRNSHMNIKYLPTTNVIGKLDDQAWRENDGLVSVVSAQHPSNQKYVDATDQIQKGVWQVTPVQHDWDHGDFVGTQKDENGISIEQFQGFWDNLLNDAIRNEKVTD

SEQ ID NO: 43344 - protein, 57 aa, Staphylococcus warneri; identical to SEQ ID NO: 43291

SEQ ID NO: 43345 - protein, 25 aa, Staphylococcus warneri
  strain SG1
MTADIISTIGDFVKWILDTVKKFTK

SEQ ID NO: 43346 - protein, 1822 aa, Staphylococcus warneri
  strain SG1
MNLFKQQKFSIRKFNVGIFSALIATIAFLGVNPNSADAAEQDNVNVGGPLTENAVNQGQPTDQVTPNENKAGNVDPTTEQVSPQNTATQEQNQQQNDNQNAVETNNAPSIDQVATEVNSEANQPNAITDQPVNEDNQEQAQTQANHEKAQETPKEKQDKEAPVDHNEGLNKQDKPVATVENNQTPKKRNKRDVGDDQNGNNVAPNQNQPVNTQDEALENAKQGATNEINQKATEKNQVIENTTEATQEEKQLALNDVAHQQFNANNNVNQANTTNDVTTAKNNGIAAIDAINVQARTRDAARNAVVQKVADQILTINNNPDATDEEKQDAVNQVHQTEQQALKDINAANTENEINGIQTQNVNAIGNVVPTSLAKPNAIAEVNQAAATQNGDIDTNQNATNEEKAVAKEQVDGLVKNATTNINDATNNQDVTQAKELGINQIKAVTPATTIKDDAKNELNQSADQIRNNNTNNYLDATTEEVNEARDHGIQELQNIAPDVVKKPAARNEINQAFEQKKQAINDSNQSTTEEKNDAINVLVPRKNEADNNIDQALTNDEVSTAVTNGINQINDVTPSTDKKQQAKSTIAQDAENKKQLLNQDTNSTTEEHNAANANVDAAVTKANNDIDQAASNADVDNAVTTNQADINQIQQEAQVKPAAKAEIAQKVTDQEAVIQNTRGTTTEEKNEAQQALQNAKTQAEQAIDAAQSNADVENVKNEEIAKIEAITPSKDYKNNAIAELENVANQRKHDLTQDPDMTKEEYDYAIDSVDRMLGQGSANVYQAGNKQSVDDNKNDGINTINQVQAFVTTKANARNEITQAADQRKATFPNDNNATTEEKEEASNNVDAIVAASNEQINQAKTDAAVNQIKDQTIQEINQVTPANTKKETALANIKTKQDQQTYIINNEPNATAEEKEAALQALTQAVTTANDEINAATTNAQVETAVQNGETNISNVIPQTQTKTNAKNEVDQAAANQNAAIEQNQDATTEEKDAAKQLVARTQNNANQAIVNAENAADVETKKNEGINSIGQITADTGIKTAVKTDLQNQANDKKQQIANNNGSTEEEKQAANTKVDDALQQGLTDVTNAQSIVDVNNAVKSTDQAIQSVQPETTVKDNAKQAIQNSINQQKEVINQNPEATQEEKQLASNKLNDIANQVTGNIDQANTSNDVDQAKNEGTTQINQFVPSIVKKSNANQELDNTADLKQEELDKTPNATQEDIAEAKQAVQKALTTAKDQVAQAQTDQDVDNAKSNGLAEIKAIQPIGTLRQAALEEFTDVYNDKVSEIEADIDGTREEVNDALKDLEAIKTQAEASINQAINVARLTAAKEHAIENVNQFDVTFTKKPSAIVSINQVATTKENEINANTTATAQEKEAAIQNVKEQLEIAEININNGETNQEVEYALTNGETAINGINAEVVTRPNAINSIDNLATQLKETFANTPGATVDELNEANQQVDQIVQSAKTEIANTTSDIDIAQIKANAMNDLNAVVVNVEQKAIAANTLKEQADKVQDMIDSNDDATETEKLAAEEQLNDILEQGLSDIDAKDTNDDITKVKESALEQLKAINVVAVVKPEARNTIANLVQKQIDKINQTPKATKEEKEAAIEQLNPIEQNAIELIKATPSDSEVKTIVKDAEQQISQIEAQASIKDETEKEINKHIQQQKVIINNADVSQRQKDKALSQLDRLASLIADQLDAADTNEAVIKVKEEAIEQIEAILPETDQQSPQKPDVGSNPTKEANGNDEGNDESNTLTKDESEETIETDSEVDKQDSSETLPETGQHDNQLPLAGITFAAGAALVSRRLAQKKDELK

SEQ ID NO: 43347 - protein, 733 aa, Staphylococcus warneri
  strain SG1
MKNRKNSYSIRKLSVGASSIIVASMLFVGAESAQAAETESQDQTTVQNVKETTESSNSNQTQQQPSEPTKAKDSDTNNTNVERPESNSTQTSNQDTDKMQDTSTNQTNENSKHIIDKTNDVSHETTKTNDTDQTSSQDNSEQSLEVDSNEAPASNDKSTPTKQEPTNSKQDIDETSKPNEDSKLVPSKSNITSKADKQEQSSKEPVEDNAQKDKHVSQEDSSIEKQGTQEVPQTDTHKDVNVTPSKSSSEQQLSTTQHITAKDSSASQEVPVHSLDSSKQDHTTSTESHINLDNLDKQATKDSTPTDNNDDQSKDGLNTLTKNAVAIHNNKSKAQATQPTKDQTNKVAPQQQYKNHDPIILVHGFNGFTADNGPGLGDSNYWGGERLNITQEARAKGYNVSEASVSALGSNYDRAVELYYYIKGGTVDYGAAHAAKYGHERYGKSYAGAYRDWKPGQKIHLIGHSMGGQTVRLLEEMLRNGNPEEIEYQKQHGGEISPLYKGGQDNMISSITTLASPHNGTHASDLLGNEAIVRQAVYDFAKSQGNKFSRADLGLTQWGLKQRPDETYIDYVKRVENSNLWKTKDNGFYDLTTEGAQELNNHTSLNPNIVYKTYTGESSDPDNNGIHHRNSHMNIKYLPTTNVIGKLDDKAWRENDGLVSVISAQHPSNQKYVDATDQIQKGVWQVTPVQHDWDHGDFVGTQKDENGISIEQFQGFWDNLLNDAIRTEKVTDQ

SEQ ID NO: 43348 - protein, 175 aa, Staphylococcus warneri
  strain SG1
MKKGLIATTLAGTVLATGVLTGQAHAAEQKQPIYVFTEKQFNEHRTGETEGFGGGPGSDVGVVMGNETYQQYLQRVKEGQYNAEHSGLPIKYVYPKDAEQNNIQQPNQNNTNMNHQSSTPQTVANAQQQPEQSSQATVLPETGQQTSNSGVILSSILGVIGSAVLLISRKFKQQA

SEQ ID NO: 43349 - protein, 1293 aa, Staphylococcus warneri
  strain SG1
MKKRMDFLPNKMNKYSIRRFTVGTASILVGATLVFGIGNNEAHASEKTNTEESTQSNEDTASQDSVKQKSDVQTSEQATNNNVNPEQVDVTNEANTSEESTTEEAPKADTTKEESATEGAPKADTTKEESATEEAPKADTTKEAPATEEEPKADTTKEAPATAEEPKADTTKEAPTTEEEPKADTTKEAPVTTEEQTPKTTTDQAPESNQTDSQETTTKQSSQPTTQSQKSPQATTTQEFDTVVNDVQNAATTEDKQEALTNYIADTNNTSKEDAKAQVENLDLDYNHLDETILLSALAQDYSNKKDSTTTYATPRSTTSTPKPVNRLGIKKLAAVRQGTNVNDKVHFSNIDIAIDRGHTNPQTGQKEFWATSSDVLKLKSDYTIDDDVHEGDQMTFQYGKYFRPGSVSLPSTQQNLYDANGGLVAKGIYDSNTNSTTYTFTNYVDQYNNIKGSFEQITFAKRENATTDKTAYPMQVTLGNQSYSKDITVDYGNKKNAPIITSTNYIENGTLARHMTAYINQPKSTFTKETFTTNLTGFKFDPTKNNFKIYEVTNQNQFVDSFTPDTSNLKDVTSNFKINYSNNNQTATVDLLNGAKSSNKQYIIEQVAYPLDTANDTNGKIDYRLDTNEKIYTWSNSYSTAAGSSTANGDLKKYSLGDYVWEDTNKDGKQDADEKGIQGVYVILKDANGKELDRTTTDSTGKYQFNDLTNGTYTVEFSTPEGYTPTTANAGTDDSVDSDGLTTTGVIKDADNWTLDSGFYKTPKYSLGDYVWLDTNKDGKQDDTEKGIPGVTVTLKDKDGNVLQTTTTDSTGKYRFDNLDNGDYIVHFDKPANLTQTTVDSTDDDKDADGEDVHVTIKDHDDFTIDNGYFEEDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADKEHGDDALPETGDDSNQNNATLFGSLFAALGSLFLFGRRRKKDADNK

SEQ ID NO: 43350 - protein, 746 aa, Staphylococcus warneri
  strain SG1
MKNRENKYSIRKFSVGTSSILIAALLFIGGGSAQAAENQDKGNVDSEAQQAQSIGEQQGNDVKNEQTNQSSELKERNDSVEAQNDNQQDATPTSLHKETSEKDTTQTSQDNTEEKQTKDATVETEQSANQVQQDVKTTKEKTTEDQATKSVEKSDATTPNQKDKADGKATKEETPTPSPKAQDKASSTQTHQHDVDPEFNSKHKASQVDPEFSHKQAQKKADVDSEFNKNHKAQQVDPDFSRRHATEKATHATVNKEKADATINQKDQQKVTAQSVDQKATAPKQTDSSQKSKQKQPVSLEQLEKDSPLLSKDNPSKKDKEQKDGLQALKSNSVATLNNQSKNKVAVADKDQTNKKAKQQQYKNHDPIILVHGFNGFTDDINPAVLSHYWGGDKMNIRQDLEENGYKSYEASISAFGSNYDRAVELYYYIKGGRVDYGAAHAAKYGHERYGKTYEGVYKDWKPGQKVHLVGHSMGGQTIRQLEELLRNGNQEEIEYQKKHGGTISPLFKGNNDNMVSSITTLGTPHNGTHASDVLGNEAVVRQVVYDIGKAFGNKDSRVDFGLSQWGLKQKPNESYIDYAKRVKNSKLWKSQDNGFYDLTRDGATDLNRKTSLNPNIVYKTYTGEATHPSLFGRQKADLNMFLPFILTGNVIGKANEKEWRENDGLVSVISSQHPFNQKYTQATDKNQKGIWQVTPTKHDWDHVDFVGQDSSDTVRTREELQQFWHGLADDLVQSEKLTSEQKAQA

SEQ ID NO: 43351 - protein, 62 aa, Staphylococcus warneri
  strain SG1
ADADADADADADADADADADADNEKLPDTGNNSHNGTLFGSLFAALGALLLGKRRKNDNKEQ

SEQ ID NO: 43352 - protein, 243 aa, Staphylococcus warneri
  strain SG1
MKKTIIASSLAVGLGVVAGNAGHDAHASEANINEAELAQKAQSNDQSLNESPIQEGAYNYTFDYNGFTYHFESDGSNFSWDFHQSGQSSEASNTQAQPQQDVSEQASASTNQTSAEEVSNQQQSNSAQPEQVSAPQTEQTQQPQQEATTSNNESSSNEASSGSSVNVNDHLKQIAQRESGGDIHATNPSTGASGKYQFLQSTWDSVAPSEYKGQPASSAPEHVQDAAAQKLYDTAGPSQWVTA

SEQ ID NO: 43353 - protein, 128 aa, Staphylococcus warneri
  strain SG1
MKHPRKDNQENKKINYFSIRKLKGYGVTSITIASLYLLFGHSNIANAAEINQPNEIEFNYTNSKVVKDKQDEKQLNQNSEIINEIPNNTNNEATPIMDDKQVTSEQSISGNNEQLKQLIQQYKKNKFR

SEQ ID NO: 43354 - protein, 25 aa, Staphylococcus warneri
  strain SG1
MAADIISTIGDLVKLIINTVKKFQK

SEQ ID NO: 43355 - protein, 291 aa, Staphylococcus warneri
  strain SG1
MNKVNTWLTKHGLMNRLTLIVVICFVLFLILLFMFLNYNDEDNGTITITENAELRTGPNAAYPVIYKIEKGDTFEKIDKSGKWIEVKNKAGDEKGWVAGWHTNLNIHAENSKKSAPLKGKTIVLDPGHGGRDQGASSNTSSKSLEKVYTLKTAKELKTLLEKEGAHVKMTRSNDTYVSLDDRNIKGDAFISIHNDSLDSPNANGVTVYWLQDNQEALAQTLSSSIQKKSLLTNKEARQQNYQVLRQTNIPAVLLELGYISNPTDEGMVRDQLHRQVVEEAIVDGLKQYFSS

SEQ ID NO: 43356 - protein, 2189 aa, Staphylococcus warneri
  strain SG1
MNLFRKETFSIRKFKVGIFSTLIATVAFWSSTHTHLAQADETNSQPVDDVQKLQEITSNGQLDNKEELKNNQETISETGVSDVSNQGNPNNDSVNTNNQQTQIDINENTNSSIIKETQSSNNESTTMIEGASPIKTDDTVNHVKPVSEQMSVKPKQQAEEKIQNMNAVMEPATKPKKRHRRDVSNTPTVAGGTGPQNGTPQNTNGEFSIDDATIDPNINNIGNNTLNYRFTFEDVGVKPSENRNNPQVIVLNSLPGFNLIDGGKVGVLNAVLERTQVFHPGDRNNKQAQGTVLALGRVEGNDPNNHGDFNGIEKEVTVNPNSEIIFDFNTMAAGNGKGGTNLVIKDANTNTVIGNGDIQAGDMLRLFKVPDNVSNIKIQLIPNNDIMGNVRRLEKNQDGYRYYDFIDNVGIRSGSHLYISGRNKENNVKNNTNFTVTTQVTNNGKSGASMLPGAFEYSMQLPEGIEYVPNSITTSFPDGNGPNDVMNPLTENYDQGTRTLTFTSNGITSATPTQGEPTSLLANKTLNVTFNLRVKNVANPKQVTFSDAIKSKTYTQTYLNGEPPQSTVNGVPYQVNIVMNKDDLQAQYNWGVVPSDYTYASYQEYNRLKQQALTILNEDRNHVPLNQQVSQATIDNLLHQMQHTLISRVDAARELGQKADDRSDEVDTVNDLTDDENDAYRGQITNLKNDALNHIDDQTTDDGVTREKEAGINKINQVNIVPVIKPNARQAINDKANEQRQRIQQDPVATKEEKEAANAQVDNHVATAMNNINQAHTNDAVNDAKNNGMNEINSDVPANTYRANAIAAINQAVVKQREQINQNQEATQEERDNALNELNQASEQAIQNIKQGISNSDVDDAKNKGIDAILDIAPVTIVKQAAREAIANNAQQKIADINTNHEATLEEREAAIQLVNQAVTSANDNILKANTNNDVDVVKNNALNQIQAITPATIVKTNAKNALNQKAQEQHNIIFSNNEATVEEQQAAQLILDQALNTAIKNIDNADTNQQVTDAKNNGLQEIGNVQPSTQVKTDARNAVTNKANEAITNINATPGATREEKQEAVDRVNNLLNRALNDINTVNTTPMVEAIKNTALNDIGNVQPNVTKKQEAIGILNNNAATKKQNINQTPDATTEEKEAAITEVNQALNQAIEQVNQADTNAQVDQAQQNGDHNINQIQTHVVKKPEALNIVTQQYNNKLAQINQTPDATIEEKNTAIQQLNQNKQQALEALNQAQTNQEVDQVKDQAIQNIDAIQVNVVTKPDARQALIDAKTDQERVINSTQDATVEEKNAALQKLEQIFNQANASINQAQTNQKVEDVRQQAIDQINTTLPETIVKNNARNNIETEAKQRDNVIDNNVESTVEEKDAAKQLVDQAKNQALQNIAQAQTNQEVNNAVANGNQEIQQIVPETIVKTTARQTLLNAINNKKQEAIDNKEATQDEKDMFINNLNNELNDLNKQITADNTNQEVATTKDNGLENINQIVFKPTVKQNARDAIQKLVDHQQDLINQANDATNEEKNSALDRLQNAANQLLTDINNATTNAQVNQIQTKSDALIPNILPHIVVKENARTMINQTVGNQDKIINGVEDATVEEKDTATNDVNIVANKAKNDINRLTDDTEVENTKNKAINDIEQILPSTKVKTDARDSLNQTSELKLNDLSLTPDATNEEINVAKALVEKLLNQALTQINQDKTTNQVNLTEQQGVKAINDVQVNVVKKNEARTAITNVEDNKSQLFNNNDEATTEEKDEAIQQLKTILQNALKALQSDQTNQQVDQTENQSIEDINNVKLNIVKKPAAINAIDQASTKQDQEINLTNEATTEEKEIALQQLKAAVNQYTNEVSSAHTNQNVADVLSKALKEIEQIMPNIEVKPAAIEALKQLSSQIKTQINETNEATLEEKDEAINQLEEALKNSIDTVDQSLTNAEVAKAKLEWETLIKSIKPLIKVKPEANEALTSIAQQVIQDFERISEATQEEKDQAIAKVHKELEIAKILVLKALTNEEVAQVKLKEVQLIEHIQPVIEVKPTAKDDINLVANEIKEKINQLKNVNPIAIKNALDRIENILNEANMLIKDAKTNAEVAQIVKETIEKLKAIQLPTEEMQVEKTIEKEKEPVLVCVTSDNTIVIEKEIKDSCILKEEATQMLPNSGVTNYQHPIVPIMFTFGIAIFASSLKRRKKDN

SEQ ID NO: 43357 - protein, 434 aa, Staphylococcus warneri
  strain SG1
MPIITDVYAREVLDSRGNPTVEVEVLTESGAFGRALVPSGASTGEHEAVELRDGDKSRYLGKGVTKAVENVNEIIAPEIVEGEFSVLDQVSIDKMMIQLDGTSNKGKLGANAILGVSIAVARAAADLLGQPLYKYLGGFNGKQLPVPMMNIVNGGSHSDAPIAFQEFMILPVGAESFKESLRWGAEIFHNLKSILSKRGLETAVGDEGGFAPKFEGTEDAVETIIQAIEAAGYKPGEEVYLGFDCASSEFYENGVYDYTKFEGEHGAKRSAAEQVDYLEQLINKYPIITIEDGMDENDWEGWKQLTERIGDKVQLVGDDLFVTNTEILSKGIEQGIGNSILIKVNQIGTLTETFDAIEMAQKAGYTAVVSHRSGETEDTTISDIAVATNAGQIKTGSLSRTDRIAKYNQLLRIEDELYETAKFDGIKSFYNLDK

SEQ ID NO: 43358 - protein, 2922 aa, Staphylococcus warneri
  strain SG1
MSKTEAKEILNNTDVDFNKATDEEINQAVLQAALTEMANKQKSTETLATPPRTRTFMRAMATPRMLAAAVTNTDQNVQKSLATSDNYTFASLVFDPEALDSDAVKNSTSIPFNIDAYMSGANSGTRYKIDLNLDSKIADHVTKISVNPAGSNTPVQFTRLKNDDGTPSNIWEVNYIRASGGLFGGAEILASKTASGGKIELDDTVGNILNNAGDLSNNKLNYQIYVRDSSNNTIIRTSESSGYFLTDADKDLVSLNNNKSTANANDFKASSGTASLDTKVGNNGAIIVDQQVIKDVIFGYGGAQNKQWSYNYQIDKDLIPFIQSVELDKYDYDGLKGFDKTYNAANKVADLSIDANGNGTITASDLNKLIEFNNGLPETVGMRIVIKLNQSPNNILTKDAQYDAKGNLISSTTDQVEDFTFAGYLTDNAGKLINNTLGTSSLELQDYDKDGLLDRYEREVSLTDPNNADTDGDTKNDGDEVKTYHTSPLVGQPNAADITINDTKVSGSVTLKPNAGTQTAKVINSTGQVIGTSTVNSDGTFTVTIPKSVAGQYTIAIDAPNYDNDETNTFNIVDNTIVPAPLVDPVDDNDTTIGVHGTAGSTVTVKDSNNNVIGTVTLGANSTTGTLTLSKPLAAGTQLTSTATKNGKTSAVSPTVTVTDATAPDAPVINPVTSDDTTVTGKAEPNSTVTVTFPDGTTQVTTADASGNYTVSIPANEDFTGGETIKASAKDAAGNKSVDSNVTVTDTTAPNQPTVNQVTSEDKTITGKAEPNSTVTVTFPDGTKVQAITATDGSYRVAVPTNIDLVGGETLGVTSTDKAGNTSTAANTKVVDVTAPKEPVINDVTSEDKTITGTSEPNSTVTVTFPDGTKASATADASGNYTIGIPDSEDLKGDEELSVVATDAAGNVSVDAGTTVLDKTPPEVPTINPVTSEDKTITGKAEPNSTVTVTFPDGTTANATTDGDGNYTIDIPANEDLKGGEALPVTSTDGAGNQSGAATTTVTDTTAPTVPTINPVTSEDKTITGHAEPGSTVTVTFPDGNTATGTTDADGNYVINIPTDEDLKGGEELPVTSTDKAGNKSDVATTEVTDTTAPEAPTVNPVTSDDTTITGKAEPNSTVTVTFPDGTTATGNTDADGNYVIDIPSNEDLKGGETLPVTSTDKAGNTSQPASTVVTDTTAPTVPSVIPVSSEDKTVTGKAEPGSTVTVTFPDGTTASGTTDADGNYTIDIPANEDLKGGETLPVTATDKDGNKSEEATTTVSDKTAPEAPTVNPVTSDDTQITGKAEPNSTVTVTFPDGHTASGTTDADGNYVINIPSSEDLKGGETLPVTATDKAGNTSEQASTVVTDTTAPTVPSVNPVTSDDTQITGKAEPGSTVTVTFPDGTTATGTTDADGNYTIDIPANEDLKGGETLPVTATDKDGNKSEPATTVVTDTTAPTVPSVNPVTSDDTQITGKAEPGSTVTVTFPDGNTASGTTDADGNYVINIPSGEDLKGGETLPVTATDKDGNKSEPATTVVTDTTAPTVPTVNPVTSDDKTITGKAEPGSTVTVTFPDGNTASGTTDEDGNYTITIPTNEDLKGGEALPVTSTDKAGNTSAPATTTVTDTTAPTAPSVNPVTSDDTQITGKAEPGSTVTVTFPDGTKASGTTDADGNYVIDIPANEDLKGGETLPVTATDKAGNQSGETTTTVTDTTAPTAPSVNPVTSDDKTITGKAEPGSTVTVTFPDGTTTTGTADQDGNYVIDIPANEDLKGGETLPVTATDKDGNKSEPTSTVVTDTTAPTVPSVNPVTSDDTQITGKAEPGSTVTVTFPDGTTATGTTDENGNYVIDIPSSEDLKGGETLPVTATDKDGNKSEPATTVVTDTTAPSTPTVNPVTSDDTQITGKAEPGSTVTVTFPDGKTASSTTDADGNYVINIPSSEDLKGGEELPVTATDKAGNTSDKATTVVTDTTAPTVPSVNPVTSDDTQITGKAEPNSTVTVTFPDGTKASGTTDADGNYVIDIPANEDLKGGETLPVTATDKDGNESQPSTTVVTDTTAPTVPSVNPVTSDDKTITGKAEPGSTVTVTFPDGTKASGTTDADGNYVINIPANEDLKGGETLPVTATDKDGNESEPATTVVTDTTAPEAPTVNPVTSDDTQITGKAEPNSTVTVTFPDGTTASGTTDADGNYVIDIPANEDLKGGETLPVTATDKDGNTSDKTTTVVTDTTAPTVPTINPVTSEDKTITGKAEPGSTVTVTFPDGTTATGKTDENGNYVIDIPANEDLKGGETLPVTATDKDGNESQPTTTVVTDTTAPSVPTINPVTSDDTQITGKAEPNSTVTVTFPDGTTATGKTDENGNYVIDIPSNEDLKGGETLPVTATDKDGNTSEPATTVVTDTTAPTVPTINPVTSEDKTITGKAEPGSTVTVTFPDGTTATGTTDNNGNYVINIPTNEDLKGGETLPVTSTDKDGNTSEPASTVVTDTTAPSVPTVNPVTSDDTQITGKAEPGSTVTVTFSDGTTATGTADQDGNYVIDIPSNEDLKGGETLPVTSTDKDGNQSEPAKTVVTDTTAPSVPTINPVTSEDTQITGKAEPGSTVTVTFPDGTTATGKTDENGNYVIDIPSNEDLKGGETLPVTATDKDGNTSEPATTVVTDTTAPEAPTVNPVHKGDKTITGKAEPGSTVTITFPDGTTATGKTDENGNYVIDIPAGENLKGGDHIGVTATDANGNTSPSTDGTVIDDGKPVDPSQPTDPTDPGKPTDPSHPTDPTDPGKPTDPSHPTDPTNPGEPTDPSQPTEPTNPGEPTDPSQPTEPTNPGEPTEPGQPTEPTNPGEPTEPGQPAEPTNPGEVTEPGQPTEQPTQGHVSGNNVTSNGTVQQSNHETASTNKGNNHEKDQSELPETGQDGVNKGTLFGTLLAGLGALFLFFKRRREDEEEEEK

SEQ ID NO: 43359 - protein, 688 aa, Staphylococcus warneri
  strain SG1
MKNNNSKRQFSIRKFTIGVVSIVAGITFFVSEHDVQAAEQQSSHLSQESVLSHSKPSDQDANVSSKESEIDKNINKVDDAQSYSQQNEQQSSKAENKEIQNSTQAEQVEKQEQPASNQTANHSSKESSINNQESHNKQQPSDDKTPNIKPEKIEKVDNHKRIQDQYQDKNKQVDNNQSNNSQLNQKEHPNSSNNKQQKQRLDVKPQNDNQQLQSRNDVKEKLDNQPIEQKDTKLQSNNKSKDNTTSVKSHSQQHKPHSLKTQSHLTPGQKVNTNISTNPTQQQTTNQNIKPKNTDEATIKSNQYKNKYPVVLVHGFLGLVGDNAPALYPNYWGGTKFPVKKRLEKLGYDVHEASVGAFSSNYDRAVELYHYIKGGKVDYGAAHAAKTGHDRYGKFYQGIMPDWEPGKKIHLIGHSMGGQTIRLLEHFLRHGNQEEIDYQKAHGGEISPLFTGGKDNMISSITTLATPHNGTPAADKLGNTDFVKGVFNRIGRLSGNKYSHIDLGFSQWGFKQRPDESYIDYVKRVANSKIWKTQDSAVYDLTTEGSEKLNQMTSINPNIVYTSYTGLDTHTGPLGNENPNIRQFFLFDLTSRLIGRDDNVNVRKNDGIVPVSSSLFPTNQAAKTVGMTSPTTDKGIWQVKPVMNGWDHLDFVGLDATDYKRIGEELSQFYLGIINNLIRIEDIDGIKH

SEQ ID NO: 43360 - protein, 925 aa, Staphylococcus warneri
  strain SG1
MKNHLFKVNQRQRYAIRKFSVGIGSTLIGVTLFLGMQNHAHAAENSESKTQQNTEENNASSTPNQQATSPDAKLNTNNTSTVLKHDQNQSQTKPAQTNDSHITSDMQNQPTSQMTKSTQQLNSTQDQNQNNQTINKKQTQNEAKFNATEALSKQTSQQANNHVEPSQAQTSIPQSKTFNTQSTQSQTQRHIVQRQFVKPVSRAYVANNGIVNVDDDSFTFTDLKNAFNDANVSQINFNSDHQFEFTEGLKLNRGLIINVANGKKVDFNAAPGQAQKLIDIDASLGNGQALTINNDGQLNFNNFNKGIAVHGGDSTTQLNINGGETNFNNFNQSGIDASKKFAGQISIQDAHINTNSTRDSTGSTLLLGDSFDSKLNVNHSTLNLVNNGDSPTSNAIESNSGIVNFNDSNIYSSSRAHYNFNIFNPDHRRGDQQVNFSNTDLKVNTPTDANPYKSIWIFKVPVDAVGINSEFTHFNVTNNSTISQNINGFTGDEKGIELEHSTLTVENGTLDLRSVGFDKGSSLNSSLAWPSLIDIKDDSKVTIDKFHDLPSNSNVSTDFPKIIISGGSVSLPLDEKGNAQVPTGTQIVNENGEVLTHFAIDKSNLDKNVNNKYDLTITSDPNDPINHPEYNYGLNENKLHDQTAHVWAPAVTVDFFKDKNDAQNNQNSITEDHVITPRGNTIGLVDKSAPTTLDGNPVKWFYSDNDQPYSDGDKILKDTKLYPVIQMMPLNEAPTITTSPQVIHEGDHNFEVIKVVTSATDKEDGDLTNKVEIIDNGGFNADVPGQYTITVKVTDSEGASYITTETVTVIPVDSDSDSDSDSDSDSDSDSDSDSDSDSDSDSDSDSDSDSDSDSDSDSDSDSDSDSETHKDVEHHSALHADSHHHTDKLPETGQQNEASTTTLMGGILAGIASLLLLGRRRKNQK

SEQ ID NO: 43361 - protein, 333 aa, Staphylococcus warneri
  strain SG1
MEENYNEEQQRKQWEQFQEFQRQQEKQKYVKSKSKKPWIWVGVGCLVFFILIIIGIVALTFSMNGGFKHHATGTKNYKIGDTIKNGDLEVKVKSIENTKAVGPSIAPTNAKDTFVVADVSIKNKGDKALTIDSQMFKLKSGDKSFEADATGSVSANQSDDGSITNSFFLEQINPDSTAEGKVVFDVSEKVANTKDKKLEITSSLFSTKSITVDLSDAKTSTKDKKDDDATNDESTSSTTSGSSDDTSSSNTGNSTSSSASPSSNTGSHQDASSSSSKATPSKEDSSSSAPKESEPQESKSAIPNSENTPKPSNNTSSNSAPSSAPSDSSSKSE

SEQ ID NO: 43362 - protein, 67 aa, Staphylococcus warneri
  strain SG1
MKNKQGFLPNKLNKYAIRKFTVGTASLLIGATLVFGVGNVARADELDNASSQNNDGNKDKSEPVDIT

SEQ ID NO: 43363 - protein, 176 aa, Staphylococcus warneri
  strain SG1
MKKLSILATTTLAGTLLFAGAGSANAAENNSSNSQLQNTAKDYLNSHHVQINKNSELVVEDNDRVSGNVPKGYKPVMFGEQGNNGPSYILVNANGDIIDPQHRQTTSEQNQNTNNTENTTNQHQTDNRQANNNSQNKVASLPTTGQETNTTFISSVAAILLGLGSILTFKRFTKEK

SEQ ID NO: 43364 - protein, 849 aa, Staphylococcus warneri
  strain SG1
MKKSKKRLDFLPNKLNKYSIRRFSVGTASILVGATLLFGINNEAHAAEQNETQSVSQEATNEDSVSEAPQETPAKEEATNDDSTSEAPQKTPAKEEATNDDSTSEAPQKTPAKEEATNDDSTSEAPQETPAKEETTNDDSTSEAPQETPAKEEATNDDSTSEAPQKTPAKEEATNDDSTSEAPQETPAKEEATNDDSTSEASQETPAKEEATNDDSTSEAPDYVGVNSDFLENSTLENSDDESSNDQDKDIAYATPAEATAPRSIEPRSRVALNEDQAQKQGKNVNDLITVTNQSITEGGREDGIISAHDGESITYTTDFKIDNDVTSGDTMTVKYDPRTAPSDLTDDHIPVDIMDPSGEVIARGSFDDTNKTSTYTFTDYVDKYENVNAKLIMNSFIDKKEVPNEETVDLTFATANEPISKTFNVSYQRPIVERASNIQSIFSHLNLDNNTVEQTVYVNPLSLNAQNAKVLIRGAGVYDDGGFFNGEGSTIIDNNTDIKVYKAKPGQRLPQNNRIYDYSQYEDVTNQVNIDKNYSNNQAMVDFGNINSPYIIKVESKYTPGAEDSLAIQQGVRMTTSNNGILSYAGYTNSIISTNDQGGGIGEEAPEKTYKIGDYVWEDVDKDGIQGTDEKEKPISNVLVTLTYPDGTSKSVRTDENGHYEFDNLYDGETYQVSFETPDGYEPTKVNAGNNGELDSNGNNVSVTINGSDDMTLDSGFYKTPKYSIGDYVWLDSNKDGVQGEEENGISGVTVTLKDKEGKTLQTTQTDEKGKYRFDNLDSGDYKVVFEKPEGLTQTSTNSTNSDKDADGEEVDVTITDHDDFSIDNGYFEDDTDADADADADADADADA

SEQ ID NO: 43365 - protein, 191 aa, Staphylococcus warneri L37603
MMKKGLIATTLAGTVLATGVLTGQAHAAEQLNVNNAKDIANKATINDQAKKASFSPGLSSDLGYNQSYTTQKKGDDYIISSPDEGAYTYRLTSEGKLYFMTKYDGKEYFISQTDVENGSQQSDQNNTNMNHQSTTTQTVANAHQQQEQSSQATALPETGQQTSNSGVMLSSILGIIGSAVLLISRKFKQQA

SEQ ID NO: 43366 - protein, 727 aa, Staphylococcus warneri L37603
MKNRKNSYSIRKLSVGASSIIVASMLFVGVESAQAAETEPQAQTTIQNVKETTESSNSDQTQQQHLESTKAKDSDTNNTSVERPESNSTQTSNQDTDNMQDTSTNQTNENSKHIIDKTNDVSHETTKANDTDQTSSQVNSEQSLEVDSNEKTTSNDKSTQTKQEPTNSKQDIDETSNSNEDSKLVPSKSNITSKADKQEQSSKEPVKDNTQIDKHVSQEDSSLEKQGTQEVPQTDSHKDVNVAPSKSSSTQHITAKDSSASQEVPVHSLDSSKPDHTTSTESHINLDNLDKQATKDSTPTDNDDDQSKDGLNTLTKNAVAIHNNKSKAQATQPTKDQTNKVAPQQQYKNHDPIILVHGFNGFTADNGPGLGDSNYWGGERLNITQEARAKGYNVSEASVSALGSNYDRAVELYYYIKGGTVDYGAAHAAKYGHERYGKSYAGAYRDWKPGQKIHLIGHSMGGQTVRLLEEMLRNRNPEEIEYQKQHGGDISPLYKGGQDNMISSITTLASPHNGTHASDLLGNEAIVRQAVYDFAKSQGNKFSRADLGLTQWGLKQRPDETYIDYVKRVENSNLWKTKDNGFYDLTTEGAQELNNHTSLNPNIVYKTYTGESSDPDKNGIHHRNSHMNIKYLPTTNVIGKLDDKAWRENDGLVSVVSAQHPSNQKYVDATDQIQKGVWQVTPVQHDWDHGDFVGTQKDENGISIKQFQGFWDNLLNDAVRNEKETDQ

SEQ ID NO: 43367 - protein, 76 aa, Staphylococcus warneri L37603
MSASSSESTNVSPMHPTSEAQQHDNNKPHSEALPDTGEDDNQSKGLLSGLLSLIFGLAIFRKSRKDKKDRKEDNNN

SEQ ID NO: 43368 - protein, 47 aa, Staphylococcus warneri L37603
EDKDHEDDALPETGDDSNQNNATLFGSLFAALGSLFLFGRRRKKEDK

SEQ ID NO: 43369 - protein, 123 aa, Staphylococcus warneri L37603
MKKKMDFLPNKMNKYSIRRFTVGTASILVGATLVFGISNNEAQADEKSSTEESTQSNENTSSQDSIKQKGDVQTSEQATNNNDIPEQVDVTNEVATSEASTTEEAPKADTTKEESTTEEAPKA

SEQ ID NO: 43370 - protein, 333 aa, Staphylococcus warneri L37603
MKENYNEEQQRKQWEQFQEFQRQQEKQKYAKPKSKKPWIWVGVGCLVFFILIIIGIVALTFGMNGGFKHHATGTKNYKIGDTIKNGDLEVKVKSIENTKAVGPSIAPTNAKDTFVVADVSIKNKGDKALTIDSQMFKLKSGDKSFEADATGSVSANQSDDGSITNSFFLEQINPDSTAEGKVVFDVSEKVANTKDKKLEITSSLFSAKSITVDLSDAKTSTKDNKDDDTNNNESDSSATSGSADDTSSSNTGNSTSSSASPSSNTGSHQDASSSSSKATPSKEDSSSSAPKESEPQESKSAIPNSENTPKSSNDVTSNSAPSSAPSDSSSESE

SEQ ID NO: 43371 - protein, 434 aa, Staphylococcus warneri L37603
MPIITDVYAREVLDSRGNPTVEVEVLTESGAFGRALVPSGASTGEHEAVELRDGDKSRYLGKGVTKAVENVNEIIAPEIVEGEFSVLDQVSIDKMMIQLDGTSNKGKLGANAILGVSIAVARAAADLLGQPLYKYLGGFNGKQLPVPMMNIVNGGSHSDAPIAFQEFMILPVGAESFKESLRWGAEIFHNLKSILSKRGLETAVGDEGGFAPKFEGTEDAVETIIQAIEAAGYKPGEEVFLGFDCASSEFYENGVYDYTKFEGEHGAKRSAAEQVDYLEQLINKYPIITIEDGMDENDWEGWKQLTERIGDKVQLVGDDLFVTNTEILSKGIEQGIGNSILIKVNQIGTLTETFDAIEMAQKAGYTAVVSHRSGETEDTTISDIAVATNAGQIKTGSLSRTDRIAKYNQLLRIEDELYETAKFDGIKSFYNLDK

SEQ ID NO: 43372 - protein, 66 aa, Staphylococcus warneri L37603
DSDSDSDSDSDSDSDSDADKEHGDNALPETGDDSNQNNATLFGSLFAALGSLFLFGRRRKKDADNK

SEQ ID NO: 43373 - protein, 459 aa, Staphylococcus warneri L37603
MKNRQGFLPNKLNKYAIRKFTVGTASLLIGATLVFGVGNVARADELDNASSQNNDGNKDKSEPVDITELTNTNETASTEDQATDKATTNVSEEANHADQTAATTQDTSQTEKSNTEETQNTEQANTEKASSNQTTKDSSNIEQDTINKTNDKTSTTTEDNKGVTSVTDEKSDASSTTDKNNDDKTTTAEESKTSEEPTTETTTTKETQSTDNKSASTTKETSSQDQSTNENSTTDNSSQEKQTTSTKETANTSKKASSTEKVNEPQTTTYENKVDTELGKQLAASDNKEQAVQSFLNDQVSKTEAKEILNNTDVDFNKATDEEINQAVLQAALTEMANKQKSTETLATPPKTRTFMRAMATPRMLAAAVTSPDQDAQKSLATSDNYTFASLVFDPEALDSDAVKNSTSIPFNIDAYMSGANSGTRYKIDLNLDSKIADHVTKISVNPAGSNTPVQFTRL

SEQ ID NO: 43374 - protein, 761 aa, Staphylococcus warneri L37603
MKHPRKDNQENKKINYFSIRKLKGYGVTSITVASLYLIFGHTNMANAAEFNQPTEIDNSYTNSTVIEDKQDEKKLNQNTEILNATTNNTNNETTPNNTSNEATPVMDNKQVTSEQSNSGNNEQLQQLIQQYKKINLNDKTDESIKEFNYDITNAEKFLQKESTQAEIDGYYRNFINSAAKLKRKKNNNEVQITKEQNGNKGIPATNTEPSSNNQHSQVVRQSEGASFRAVPNQNNNDPLKYNETNTGVINGHFDQVSGGNLPNQKTSLTVVKDVIGWTSLSTDPDKEFPIVMTTKVRNYPTFMSDSSAPYGVVLARTTDGFDRRVPDPRVAGIYQDIDVAPNSELVVDFISSALATINAWPGVKAKITIPDGNRVLFDKQINGMGKYPTGKLNLMVNVPSDVDRVRLSFIPISNSYTLTSNQTNSAYGFGDNPNYMYGGSVSRVNVNSGAYVVSRVTEINYDFTSDSSTSNYARGTISVILENKGHTSSNETIYRVTLPQGTKFVSATNASTNYNEATGLLTLNAGKVAAGTTKTITYTVDFPAVKPSIVDLDGNVTYRTDASFRGNDRQKSGIDKVEQQQVAILMYKEDLRNKYNDTKQYLDSINEAKAILDEANNNVPMADRKNQDFINQITTQIEHEKTKLKRLTPSIPVMTTNEENASLTVTPQGDTDKMTVQYVGPNGDPKEVVATKAGDQWTLNETPTGFSIDNTNGSVTVNYQGVQNGSEVSAYDTSGNSDSSDEVRKNVPLKQDTPLAPTITP

SEQ ID NO: 43375 - protein, 688 aa, Staphylococcus warneri L37603
MKNNNPKRQFSIRKFTIGVVSIVAGITFFISEHDVQAAEQQSSHLSQESVYTQSKPSDQEANVSSKESEIDKNINKVDGAQSYSQQNEQQSSKEDNKKMPKSTQAEQVEKQEQPASNQTPNHSSKEPSINNQQSHNKQQPSDDKIPNTEPEKIEKVDNHKRIQDQYQDKNKKVDNKQSNNSQLNQKENPDSSNNKQQKQRLDVKPQNDNQQLQSRNDVKEKLDNQPIEQTDTKQQSNNKSKDNTTSVKSHSQQHKPHSLKTQSHSTPGQKVNTNISTNPTQQQTTNQNIKPKNTDEATVKSNQYKNKYPVVLVHGFLGLVGDNAPALYPNYWGGTKFPVKKRLEKLGYDVHEASVGAFSSNYDRAVELYHYIKGGKVDYGAAHAAKTGHDRYGKVYQGIMPDWEPGKKLHLIGHSMGGQTIRLLEHFLRHGNQEEIDYQKAHGGEISPLFTGGKDNMISSITTLATPHNGTPAADKLGNTDFVKGVFNRIGRLSGNKYSHIDLGFSQWGFKQRPDESYIDYVKRVANSKIWKTQDSAVYDLTTEGSEKLNQMTSLNPNIVYTSYTGLDTHTGPLGNENPNIRQFFLFDLTSRLIGRDDNVNVRKNDGIVPVSSSLFPTNQAAKTVGMTSPSTDKGIWQVKPVMNGWDHLDFVGLDATDYKRIGEELSQFYLGIINNLIRIEEIDGIKH

SEQ ID NO: 43376 - protein, 243 aa, Staphylococcus warneri L37603
MKKTIIASSLAVGLGVVAGNAGHDAHASEANINEAELAQKAQSNDQSLNESPIQEGAYNYTFDYNGFTYHFESDGTNFSWYFHQSGQSNEASNTQAQPQQDVSEQASASTNQTSAEEVSNQQQSNSAQPEQVSAPQTEQTQQPQQEATTSNNESSSSEASSGSSVNVNDHLKQIAQRESGGDIHATNPSTGASGKYQFLQSTWDSVAPAEYKGQPASSAPEHVQDAAAQKLYDTAGPSQWVTA

SEQ ID NO: 43377 - protein, 291 aa, Staphylococcus warneri L37603
MNKINTWLTKHGLMNRLTLIVVICFVLFLILLFMFLNYNDEDNGTITITENAELRTGPNAAYPVIYKIEKGDTFEKIDKSGKWIEVKNKAGDEKGWVAGWHTNLNIHADNSKKSAPLKGKTIVLDPGHGGRDQGASSNTSSKSLEKVYTLKTAKELKSLLEKEGAHVKMTRSNDTYVSLDDRNIKGDAFISIHNDSLDSPNANGVTVYWLQDNQEALAQTLSSSIQKKSLLTNKEARQQNYQVLRQTNIPAVLLELGYISNPTDEVMVRDQLHRQVVEEAIVDGLKQYFSS

SEQ ID NO: 43378 - protein, 122 aa, Staphylococcus warneri L37603
TDPTNPGEPTEPGQPTDPTNPGEPTEPGQPANPTNPGEPTEQTTQGHVSGNNVTSNGAVQQRNHETSSTNKGNNHEKDQNELPETGQDGVNKGTLFGTLLAGLGALFLFFKRRREDEEEEEK

SEQ ID NO: 43379 - protein, 755 aa, Staphylococcus warneri L37603
MKKRMDFLPNKLNKYSIRRFTVGTASILVGATLVFGIGNNEAHASEKTSTEESTQSNEDTASQDSVKQKGDVQTNEQATNNNVNPEQVDVTNEANTSEASTTEKEPKADTTKEASTTEEAPKADTTKEAPTTAEELKVETTKEEPATAEKPKADTTKEEATTKEEPTTAEEPKADTTKEKTTTKEEPTTAEEPTTKTTSEQTPESKQIDSKRTTSEQASQPVAQSQNSAQSTKTQDDNTVVNNVKKAKTTEDKQEALTNYIADTNNTSQKEAKAQVENLDLDYNHLDETTLLSALAQDYSNKKDSTTTYATPRSTTSAPKPVNRLGVNKLAAVRQGTNVNDKVHFSNIDIAIDRGHTNPQTGQKEFWATSSDVLKLKSDYTIDDDVHEGDQMTFQYGKYFRPGSVSLPSTQQNLYDANGGLVAKGIYDSNTNSTTYTFTNYVDQYNNIKGSFEQVTFAKRENATTDKTTYPMQVTLGNQSYSKDIIVDYGNKENAPIITSTNYIENGTLARHMTAYINQPKSTFTKETFTTNLTGFKFDPTKNNFRIYEVTNQNQFVDSFTPDTSNLKDVTSNFKINYSNNNQTATVDLLNGAKSSNKQYIIEQVAYPLDTANDTNGKIDYRLDTNEKIYTWSNSYSVTAGSSTANGDLKKYALGDYVWEDTNKDGKQDADEKGIQGVYVILKDANGKELDRTTTDATGKYQFNNLTNGTYTVEFSTPEGYTPTTANAGTDDSVDSDGLTTTGVIKDADNWTLDS

SEQ ID NO: 43380 - protein, 2114 aa, Staphylococcus warneri L37603
MNLFRKETFSIRKFKVGIFSTLIATVAFLSSPITHIAQADEINSQPVNDVQKLQETTSNGQLDNNRELNNNQETLSEVGVSDVSNQANSNNDSVNTNNQQTQIETIETTDNTVIQETQSPNNELNTTIESKTPIDNNTTVNHVKPASEHMLVKPKQQAEGKIQYMNAVIEPATKPKKRQRRDVNNTPTVAGGTGPQNGNGTPQSTNGEYSRDDATIDPNINNTGNNTLNYRFTFEDVGVKPSDNRNNPQVIVLNSLPGFNLINGGKVGVLNAVLERTQVFHPGDRNNKQAQGTVLALGRVEGNDPNNHGDFNGIEKDVTVNPNSEIIFDFNTMAAGNGKGGTNLVIKDANTDTVIGNGDIQAGDMLRLFKVPDNVSNIKIQLIPNNDIMGNVRRLEKNQDGYRYYDFIDNVGIRSGSHLYISGRNKENNVKNNTNFTVTTQITNNGKSGASMLPGAFEYSMQLPEGIEYVPNSITTSFPDGNGPNDVMNRLTENYDQGTRTLTFTSNGITSATPTQGEPTSLLANKTLNVTFNLRVNNVANPKEVTFSDAIKSKTYTQTYLNGEPPQSIVNGVPYQVNIVMNKDDLQAQYNWGVVPSDYTYASYQEYNRLKQQAQTILNEDRNHVPLNQQVSQATTDQLLQQMQHTLISRVDAARELGQKADDRSDEVDNVKDLTDDENDAYRGQITNLKNEALNHIDDQTTDDGVTREKEAGINKIEQVNIVPVIKPNARQTINEKANEQKQKIQQDRIATQEEKEAANAQVDNHVTTALNNINQAHTNNAVNEAKNNGVSDINSDVPENTYRANAITAINRAAAKQREQIDENHEATQEERNTALNELNQASEQAIQNINQGISNSDVDHAKDRGLDAILDISPIPVVKQAAREAIANNAQQKIADINANHEATLEEREAAIQLVNQTVTTANDNILKANTNNDVDMVKNNALNQIQAITPATIVKSNAKNALNQKAQEQHNIIFNNNEATVEEQQAAQLILDQALNTAIQNIDNADTNQQVADAKNNGLHEIGNVQPSTQVKTDARNAVTNKANEAITNINATPGATREEKQEAVGRVNQLLNRAINDINTVNTTPMVEEIKNTALNDIGNVQPNVTKKQEAIGILNNNATAKKQNINQTPDATTEEKEAAITQVNQALNQAIEQVNQADTNAQVDQAQQNGDHNINQIQAHVVKKPEAINDINQQYNNKLAQINQTPDATIEEKNVALQKLEQIFNQANEAINQAQTNQDVEDRRQQAIEQINMTLPETLVKNNARKNIEAEANQRDNVINSNGESTLEEKDAAKQLVSQAKNQALQNIDQAQTNQDVNNAVTNGNQEIQQIVPETIVKINARQLLLNAINNKKQEALENKEATQDEKDAFINNLNNILNDLNQQITNDNTNQEVANTKDNGLEKINQTVFKPTVKQNARDALHQLVEHQQEIINQAKDATDEEKNNALDRLQNANNQLLADINSSDTNAQVNQIQSKSDDIIPNILPYIVVKENARSMINQTADNQDKVINGVKDATVEEKDAAINDVNTVVNKAKNDINRFTDDTEVENTKNKAINDIKQILPSTKVKRDARDALNQTTETKMNALSLTPDATNEEINIAKALVEKLLNQALAQINQDKTTNQVNLTEQQGVQSINDVQVNVVKKNDARAAITNAEAIKNQLFNNNGEATTEEKDDAIQQLKTILQNALNALQSDQTNQQVDQTETQSIEDINNVKLNIVKKPEAINEIDQAFTKQDQVIKLTNEATTEEKELALQQLNQAVNQYIKEVSSAQTNQNVADVLSKALKDIEQIMPNIEVKPAAVKVLKELSSQIKTHINDTNEATQEEKNDAINQLEEALKNSIDTVDQSLTNAEVAKAKIEWEILIKSIKPIVKVKPEANEALTSIAQRVIQDFDRITEATQEEKDEAIAKVHKELEIAKILVMKALTNEEVAQIKLKEVQLIEHIQPVIEVKPSAKDDINLVANEVKDKINQLKNVNPKAVKNALNRVEDILNEANALIKDAKTNDEVAQIVKETIEKLKAIQLPIAEPEVEVTLEKEIEPVVFCNTRDNKFFVEKEVKNTCNFKEESVQELPNTGITNYQHPIVPIMFTFGISIFVSSLKRRKKVS

SEQ ID NO: 43381 - protein, 1778 aa, Staphylococcus warneri L37603
MNLFKQQKFSIRKFNVGIFSALIATVAFLGVNPNSADAAEQDNVNVNGPLTDNVVNQGQPNDQTLPNENQAGNDNPANEQTSPQNAVAQEQNQQQNDNKNAVETNNEQIANPEATEANNDANQPNAVIDNPVNEGNQEQAQPQSNQEQAQETPKEKQDKESPIESNEGLNKQSKPVDTVENNQTPKKRNKRDVGDDQNGNNVAPNQNQPVNAQDEALENAKQGATNEINQKATDKNQAIDNTTEATQEEKQLALNDVAHQQFNANNNINQANTTDDVTTAKNNGIAAIDAINVQARTRDAARNAVVQKVADQILTINNNPDATNEEKQEAVNQVHQTEQQALKDINAANTENEINGIQTQNVNAIGNVVPASTAKPNAIAEVNQAAATHNGDIDANQNATNEEKAVAKEQVNGLVQNTTTNINDASNNQDVTQAKELGINQINAVTPATTVKDEAKAEVNQSAEQIRNNNTNNYMDATTEEINVANNQVDQIVNQANTAIGAANTTNEVNEARDHALQELQNVAPDEVKKPDARNTIDHAYEQKKQAINDSNQSTTEEKNDAMNVLDPRKNEAYNNIDQALTNDEVANAVTNGINQINDVTPSTDKKQQAKSTIAQDADNKKRLINQDTNSTTEEHNAANANVDAAVTKANNDIDQAASNDDVDNAVTTNQNDINQIQQEAQVKPAAKAEIAQKVTDQEGVIQNTRGTTTEEQNEAQQALQNAKTEADQAIDAAQSNADVENVKNEQIAKIAAITPSKDYKNNAIAELENVANQRKHDLTQDPDMTNEERDYANDSVDRMLGQGSANVYQAANKQSVDSNKNDGINTINQVQAFVTTKSNARNEITQAADQRKATFPNDNNATTEEKEAATNNVDALVAASNEQINQAKTDAAVNQIKDQTIQEINQVIPANTKKETALADIKTKQDQQRYIINNEPNATTEEKEAALQTLTQAVTTANDEINAATTNAQVDTAVQNGETNIGNVVPETQTKTNAKNEVDQAATNQNNTIDQNQDATTEEKDAAKQLVARTQNNANQAIVNAENAADVEAKKNEGINSIGQITADTGIKTDLQNQANDKKQQIANNNGSTEEEKQAANTKVDDALQQGLTDVTNAQSIVDVNNAVKATDQAIQSVQPETTVKDNAKQDIQNSINQQKDAVNQNPQATNEEKQLASNKLDDIANQVTGNIDHANTNNDVDQAKNEGTTQINQFVPSIVKKSIATQELDNAADLKQEELDKTPNATQEDIAEAKQAVQNALTSAKDQVAQAQTDQDVDNAKANGVSEIKAIQPIGTLRQAALEEFTDVYNDKVSEIETDIDGTQEEVNAALADLAAIKTQAEASINQAINVARLTAAKEHAIENVNQFDVTFTKKPSALTHIKQVATTKENEINANATATAQEKEAAIQNVNEQLEIAEININNGETNQEVEDALTNGETAINGINPEVVTKPNAINSIDNLATQLKETFANTPGATVDELNEANQQVDQIVQSAKTEIANVTSDIDIAQIKANAMNDLNAVVVNVEQKAIAANALKEQADKVQDMIDSNDDATETEKLAAEEQLNDILEQGLSDIDAKDTNDDITKVKESALKQLKAINVVAVVKPEARNTIANLVQKQIDKINQTPKATKEEKEAAIEQLNPIEQNAIELIKATPSDSEVKTIVKDAEQQISQIEAIEQIEAILPETEQQSPQKSDVGSNPTKEANGNDEGNDESNALTKIESDESVETDTEVDKQNSLETLPETGQHDNQLPLAGITFAAGAALVSRRMVQKKDKLK

SEQ ID NO: 43382 - protein, 747 aa, Staphylococcus warneri L37603
MKNRENKYSIRKFSVGTSSILIAALLFIGGGSAQAAENQDKGNVDSEAQQAQSIGEQQGNDVKNEQTNQSSELKKQNDSVEAQNDNQQDATPTSLHKETSEKDTTQTSQDNTEEKQPKDATVESDQSVDQVQQDVKTAPKEKTTEDQATKSVEKPDTTTPNQKDKANGKAVKEETPTPSPKAQDKASSTQTHQHDVDPEFNSRHKASQVDPEFSHKQAQKKADVDSEFNKNHKAQQVDPDFSRRHATEKATHATVNKEKSDATINQKDQHKVTAQSVDQTATAPNQTDSSQKSKQKQPVSLDQLEKDSPLLSKDNPSKKDKEQKDGLQALKSNSVATLNNQSKNKVAVADKDQTNKKAKQQQYKNHDPIILVHGFNGFTDDINPAVLSHYWGGDKMNIRQDLEENGYKSYEASISAFGSNYDRAVELYYYIKGGRVDYGAAHAAKYGHERYGKTYEGVYKDWKPGQKVHLVGHSMGGQTIRQLEELLRNGNQEEIEYQKKHGGTISPLFKGNNDNMVSSITTLGTPHNGTHASDLLGNEAVVRQVVYDIGKAFGNKDSRVDFGLSQWGLKQKPNESYIDYAKRVKNSNLWKSQDNGFYDLTRDGATDLNRKTSLNPNIVYKTYTGEATHPSLFGRQKADLNMFLPFILTGNVIGKANEKEWRENDGLVSVISSQHPFNQKYTQATDKNQKGIWQVTPTKHDWDHVDFVGQDSSDTVRTREELQQFWHGLADDLVQSEKLTSEQKAQA

SEQ ID NO: 43383 - protein, 434 aa, Staphylococcus warneri VCU121
MPIITDVYAREVLDSRGNPTVEVEVLTESGAFGRALVPSGASTGEHEAVELRDGDKSRYLGKGVTKAVENVNEIIAPEIVEGEFSVLDQVSIDKMMIQLDGTSNKGKLGANAILGVSIAVARAAADLLGQPLYKYLGGFNGKQLPVPMMNIINGGSHSDAPIAFQEFMILPVGAESFKESLRWGAEIFHNLKSILSKRGLETAVGDEGGFAPKFEGTEDAVETIIQAIEAAGYKPGEEVFLGFDCASSEFYENGVYDYTKFEGEHGAKRSAAEQVDYLEQLINKYPIITIEDGMDENDWEGWKQLTERIGDKVQLVGDDLFVTNTEILSKGIEQGIGNSILIKVNQIGTLTETFDAIEMAQKAGYTAVVSHRSGETEDTTISDIAVATNAGQIKTGSLSRTDRIAKYNQLLRIEDELYETAKFDGIKSFYNLDK

SEQ ID NO: 43384 - protein, 129 aa, Staphylococcus warneri VCU121
MKKRMDFLPNKMNKYSIRRFTVGTASILVGATLVFGIGNNEAHASEKTNTEESTQSNEDTASQDSVKQKSDVQTSEQATNNNVNPEQVDVTNEANTSEESTTEEAPKADTTKEESATEGAPKADTTKEE

SEQ ID NO: 43385 - protein, 203 aa, Staphylococcus warneri VCU121
MKTTKILGTTTLAGALLFTGVGATHSNEAHADTQEITLPTPSEWQTQHDKLVQAKAEHPNQGGEGGGPGAITSYDKSYEEYIQKNLDYERKYETVDFKIPQEGKAYLNGQNSDNSNNQQLSQNNDQQAQNQATDNTVNTQNNDQQQTQTTDNNTTTQTNTQEQAKVLPETGESSNTTILTIVASVLLAAGSLLVFRRTSKSNK

SEQ ID NO: 43386 - protein, 79 aa, Staphylococcus warneri VCU121
SDSDSDSDSDSDSDSDSDSDSDSDSDSDSDADKEHGDDALPETGDDSNQNNATLFGSLFAALGSLFLFGRRRKKDADNK

SEQ ID NO: 43387 - protein, 91 aa, Staphylococcus warneri VCU121
DADADADADADADADADADADADADADADADADADADADADADADADADADNEKLPDTGNNSHNGTLFGSLFAALGALLLGKRRKNDNKEQ

SEQ ID NO: 43388 - protein, 1849 aa, Staphylococcus warneri VCU121
MNLFKQQKFSIRKFNVGIFSALIATIAFLGVNPNSADAAEQDNVNVGGPLTENAVNQGQPTDQVTPNENKAGNVDPTTEQVSPQNTATQEQNQQQNDNQNAVETNNAPSIDQVATEVNSEANQPNAITDQPVNEDNQEQAQTQANHEKAQETPKEKQDKEAPVDHNEGLNKQDKPVATVENNQTPKKRNKRDVGDDQNGNNVAPNQNQPVNTQDEALENAKQGATNEINQKATEKNQVIENTTEATQEEKQLALNDVAHQQFNANNNINQANTTNDVTTAKNNGIAAIDAINVQARTRDAARNAVVQKVADQILTINNNPDATDEEKQDAVNQVHQTEQQALKDINAANTENEINGIQTQNVNAIGNVVPTSLAKPNAIAEVNQAAATQNGDIDTNQNATNEEKAVAKEQVDGLVKNATTNINDATNNQDVTQAKELGINQIKAVTPATTIKDDAKNELNQSADQIRNNNTNNYLDATTEEVNAANNQVDQIVNQGNTAIGAANTTEEVNEARDHGIQELQNIAPDVVKKPAARNEINQAFEQKKQAINDSNQSTTEEKNDAINVLVPRKNEADNNIDQALTNDEVSTAVTNGINQINDVTPSTDKKQQAKSTIAQDAENKKQLLNQDTNSTTEEHNAANANVDAAVTKANNDIDQAASNADVDNAVTTNQADINQIQQEAQVKPAAKAEIAQKVTDQEAVIQNTRGTTTEEKNEAQQALQNAKTQAEQAIDAAQSNADVENVKNEEIAKIEAITPSKDYKNNAIAELENVANQRKHDLTQDPDMTKEEYDYAIDSVDRMLGQGSANVYQAGNKQSVDDNKNDGINTINQVQAFVTTKANARNEITQAADQRKATFPNDNNATTEEKEEASNNVDAIVAASNEQINQAKTDAAVNQIKDQTIQEINQVTPANTKKETALANIKTKQDQQTYIINNEPNATAEEKEAALQALTQAVTTANDEINAATTNAQVETAVQNGETNISNVIPQTQTKTNAKNEVDQAAANQNAAIEQNQDATTEEKDAAKQLVARTQNNANQAIVNAENAADVETKKNEGINSIGQITADTGIKTAVKTDLQNQANDKKQQIANNNGSTEEEKQAANTKVDDALQQGLTDVTNAQSIVDVNNAVKSTDQAIQSVQPETTVKDNAKQAIQNSINQQKEVINQNPEATQEEKQLASNKLDDIANQVTGNIDQANTSNDVDQAKNEGTTQINQFVPSIVKKSNANQELDNTADLKQEELDKTPNATQEDIAEAKQAVQKALTTAKDQVAQAQTDQDVDNAKSNGLAEIKAIQPIGTLRQAALEEFTDVYNDKVSEIEADIDGTREEVNDALKDLEAIKTQAEASINQAINVARLTAAKEHAIENVNQFDVTFTKKPSAIVSINQVATTKENEINANTTATAQEKEAAIQNVKEQLEIAEININNGETNQEVEDALTNGETAINGINPEVVTRPNAINSIDNLATQLKETFANTPGATVDELNEANQQVDQIVQSAKTEIANTTSDIDIAQIKANAMNDLNAVVVNVEQKAIAANTLKEQADKVQDMIDSNDDATETEKLAAEEQLNDILEQGLSDIDAKDTNDDITKVKESALEQLKAINVVAVVKPEARNTIANLVQKQIDKINQTPKATKEEKEAAIEQLNPIEQNAIELIKATPSDSEVKTIVKDAEQQISQIEAQASIKDETEKEINKHIQQQKVIINNADVSQRQKDKALSQLDRLASLIADQLDAADTNEAVIKVKEEAIEQIEAILPETDQQSPQKPDVGSNPTKEANGNDEGNDESNTLTKDESEETIETDSEVDKQDSSETLPETGQHDNQLPLAGITFAAGAALVSRRLAQKKDELK

SEQ ID NO: 43389 - protein, 2189 aa, Staphylococcus warneri VCU121
MNLFRKETFSIRKFKVGIFSTLIATVAFWSSTHTHLAQADETNSQPVDDVQKLQEITSNGQLDNKEELKNNQETISETGVSDVSNQVNPNNDSVNTNNQQTQIDINENTNSSIIKETQSSNNESTTMIEGASPIKTDDTVNHVKPVSEQMSVKPKQQAEEKIQNMNAVMEPATKPKKRHRRDVSNTPTVAGGTGPQNGTPQNTNGEFSIDDATIDPNINNIGNNTLNYRFTFEDVGVKPSENRNNPQVIVLNSLPGFNLIDGGKVGVLNAVLERTQVFHPGDRNNKQAQGTVLALGRVEGNDPNNHGDFNGIEKEVTVNPNSEIIFDFNTMAAGNGKGGTNLVIKDANTNTVIGNGDIQAGDMLRLFKVPDNVSNIKIQLIPNNDIMGNVRRLEKNQDGYRYYDFIDNVGIRSGSHLYISGRNKENNVKNNTNFTVTTQVTNNGKSGASMLPGAFEYSMQLPEGIEYVPNSITTSFPDGNGPNDVMNPLTENYDQGTRTLTFTSNGITSATPTQGEPTSLLANKTLNVTFNLRVKNVANPKQVTFSDAIKSKTYTQTYLNGEPPQSTVNGVPYQVNIVMNKDDLQAQYNWGVVPSDYTYASYQEYNRLKQQALTILNEDRNHVPLNQQVSQATIDNLLHQMQHTLISRVDAARELGQKADDRSDEVDTVNDLTDDENDAYRGQITNLKNDALNHIDDQTTDDGVTREKEAGINKINQVNIVPVIKPNARQAINDKANEQRQRIQQDPVATKEEKEAANAQVDNHVATAMNNINQAHTNDAVNDAKNNGMNEINSDVPANTYRANAIAAINQAVVKQREQINQNQEATQEERDNALNELNQASEQAIQNIKQGISNSDVDDAKNKGIDAILDIAPVTIVKQAAREAIANNAQQKIADINTNHEATLEEREAAIQLVNQAVTSANDNILKANTNNDVDVVKNNALNQIQAITPATIVKTNAKNALNQKAQEQHNIIFSNNEATVEEQQAAQLILDQALNTAIKNIDNADTNQQVTDAKNNGLQEIGNVQPSTQVKTDARNAVTNKANEAITNINATPGATREEKQEAVDRVNNLLNRALNDINTVNTTPMVEAIKNTALNDIGNVQPNVTKKQEAIGILNNNAATKKQNINQTPDATTEEKEAAITEVNQALNQAIEQVNQADTNAQVDQAQQNGDHNINQIQTHVVKKPEALNIVTQQYNNKLAQINQTPDATIEEKNTAIQQLNQNKQQALEALNQAQTNQEVDQVKDQAIQNIDAIQVNVVTKPDARQALIDAKTDQERVINSTQDATVEEKNAALQKLEQIFNQANASINQAQTNQKVEDVRQQAIDQINTTLPETIVKNNARNNIETEAKQRDNVIDNNVESTVEEKDAAKQLVDQAKNQALQNIAQAQTNQEVNNAVANGNQEIQQIVPETIVKTTARQTLLNAINNKKQEAIDNKEATQDEKDMFINNLNNELNDLNKQITADNTNQEVATTKDNGLENINQIVFKPTVKQNARDAIQKLVDHQQDLINQANDATNEEKNSALDRLQNAANQLLTDINNATTNAQVNQIQTKSDALIPNILPHIVVKENARTMINQTVGNQDKIINGVEDATVEEKDTATNDVNIVANKAKNDINRLTDDTEVENTKNKAINDIEQILPSTKVKTDARDSLNQTSELKLNDLSLTPDATNEEINVAKALVEKLLNQALTQINQDKTTNQVNLTEQQGVKAINDVQVNVVKKNEARTAITNVVDNKSQLFNNNDEATTEEKDEAIQQLKTILQNALKALQSDQTNQQVDQTENQSIEDINNVKLNIVKKPAAINAIDQASTKQDQEINLTNEATTEEKEIALQQLKAAVNQYTNEVSSAHTNQNVADVLSKALKEIEQIMPNIEVKPAAIEALKQLSSQIKTQINETNEATLEEKDEAINQLEEALKNSIDTVDQSLTNAEVAKAKLEWETLIKSIKPLIKVKPEANEALTSIAQQVIQDFERISEATQEEKDQAIAKVHKELEIAKILVLKALTNEEVAQVKLKEVQLIEHIQPVIEVKPTAKDDINLVANEIKEKINQLKNVNPIAIKNALDRIENILNEANMLIKDAKTNAEVAQIVKETIEKLKAIQLPTEEMQVEKTIEKAKEPVLVCVTSDNTIVIEKEIKDSCILKEEATQMLPNSGVTNYQHPIVPIMFTFGIAIFASSLKRRKKDN

SEQ ID NO: 43390 - protein, 889 aa, Staphylococcus warneri VCU121
MKHPRKDNQENKKINYFSIRKLKGYGVTSITIASLYLLFGHSNIANAAEINQPNEIEFNYTNSKVVKDKQDEKQLNQNSEIINEIPNNTNNEATPIMDDKQVTSEQSISGNNEQLKQLIQQYKKINLDDKTDESIKEFNHDISNAEQFLQKQSTQAEIDGYYRNFINSASKLKRKKNNDQVLTIKKQNANKGVPATNSEPSSNNQHSQVVRQPRGTSFRAVPNQNSNDPLKYNETNTGVINGHFDQVSGGNLPNQNTSLTVVKDVIGWTSLSTDPDKEFPIVMTTRVRNYPTFMSDSSAPYGVVLARTTDGFERRVPDPRVAGIYQDIDVAPNSELVVDFISSALATINAWPGVKAKITTPDGNRVLFDKQINGMGKYPTGKLNLMINIPSDVDRVRLSFIPISNSYTLTSNQTSSAYGFGDNPNYMYGGAVSRVNVNSGAYVVSRVTEVKYDFTSDSSTSNYARGTITVILENKGHTSSNETIYRVTLPQGTKFVSATNASTNYNEATSILTLNAGKVSAGTTKTISYTVDFPAVKPSIVDLDGNVTYRTDASFRGDDRQKSGIDEVEQQQVAILMYKEDLRNKYNDTKQYLDTINEADYTTVSVNNLKLKLDEAKAILDEANNNVPMADRKNQDFINQITTEIEHEKIKLKRLTPSIPVMTTNEENASLTVTPQGDTDKMTVQYIGPNGDAKEVIATKAGNQWRLNDTPTGFSIDNRNGSVTVNYQGVQNGSEVSAYDTSGNSDPSDEVRKNVPLKQDTPLAPVITPDEANASVTVTPQGDSDKMTVHYIAPNGDPKEVIATKTGDQWTLNETPTGISIDNTSGAVTVSYQGIQNGSEVISTEKYGNSDTSPEARANVPVKEATPAAPTITPDEASASVTVIPQGDS

SEQ ID NO: 43391 - protein, 333 aa, Staphylococcus warneri VCU121; identical to SEQ ID NO: 43361

SEQ ID NO: 43392 - protein, 176 aa, Staphylococcus warneri VCU121; identical to SEQ ID NO: 43363

SEQ ID NO: 43393 - protein, 688 aa, Staphylococcus warneri VCU121; identical to SEQ ID NO: 43359

SEQ ID NO: 43394 - protein, 973 aa, Staphylococcus warneri VCU121
MKNHLFKVNQRQRYAIRKFSVGIGSTLIGVTLFLGMQNHAHAAENSESKTQQNTEENNASSTPNQQATSPDAKLNTNNTSTVLKHDQNQSQTKPAQTNDSHITSDMQNQPTSQMTKSTQQLNSTQDQNQNNQTINKKQTQNEAKFNATEALSKQTSQQANNHVEPSQAQTSIPQSKTFNTQSTQSQTQRHIVQRQFVKPVSRAYVANNGIVNVDDDSFTFTDLKNAFNDANVSQINFNSDHQFEFTEGLKLNRGLIINVANGKKVDFNAAPGQAQKLIDIDASLGNGQALTINNDGQLNFNNFNKGIAVHGGDSTTQLNINGGETNFNNFNQSGIDASKKFAGQISIQDAHINTNSTRDSTGSTLLLGDSFDSKLNVNHSTLNLVNNGDSPTSNAIESNSGIVNFNDSNIYSSSRAHYNFNIFNPDHRRGDQQVNFSNTDLKVNTPTDANPYKSIWIFKVPVDAVGINSEFTHFNVTNNSTISQNINGFTGDEKGIELEHSTLTVENGTLDLRSVGFDKGSSLNSSLAWPSLIDIKDDSKVTIDKFHDLPSNSNVSTDFPKIIISGGSVSLPLDEKGNAQVPTGTQIVNENGEVLTHFAIDKSNLDKNVNNKYDLTITSDPNDPINHPEYNYGLNENKLHDQTAHVWAPAVTVDFFKDKNDAQNNQNSITEDHVITPRGNTIGLVDKSAPTTLDGNPIKWFYSDNDQPYSDGDKILKDTKLYPVIQMMPLNEAPTITTSPQVIHEGDHNFEVIKVVTSATDKEDGDLTNKVEIIDNGGFNADVPGQYTITVKVTDSEGASYITTETVTVIPVDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSETHKDVEHHSALHADSHHHTDKLPETGQQNEASTTTLMGGILAGIASLLLLGRRRKNQK

SEQ ID NO: 43395 - protein, 733 aa, Staphylococcus warneri VCU121; identical to SEQ ID NO: 43347

SEQ ID NO: 43396 - protein, 162 aa, Staphylococcus warneri VCU121
MKNKQGFLPNKLNKYAIRKFTVGTASLLIGATLVFGVGNVARADELDNASSQNNDGNKDKSEPVDITELTNTNETASTEDQATDKATTNASEEASNADQTTATTQDTSQTEKSNAEETQSTEQANTEKASSNQTTKDSSNIEQDTINKTNDKPSTTDKTATT

SEQ ID NO: 43397 - protein, 728 aa, Staphylococcus warneri VCU121
MKNRENKYSIRKFSVGTSSILIAALLFIGGGSAQAAENQDKGNVDSEAQQAQSIGEQQGNDVKNEQTNQSSELKERNDSVEAQNDNQQDATPTSLHKETSEKDTTQTSQDNTEEKQTKDATVETEQSANQVQQDVKTTKEKTTEDQATKSVEKSDATTPNQKDKADGKATKEETPTPSPKAQDKASSTQTHQHDVDPEFNSKHKASQVDPEFSHKQAQKKADVDSEFNKNHKAQQVDPDFSRRHATEKATHATVNKEKADATINQKDQQKVTAQSVDQKATAPKQTDSSQKSKQKQPVSLEQLEKDSPLLSKDNPSKKDKEQKDGLQALKSNSVATLNNQSKNKVAVADKDQTNKKAKQQQYKNHDPIILVHGFNGFTDDINPAVLSHYWGGDKMNIRQDLEENGYKSYEASISAFGSNYDRAVELYYYIKGGRVDYGAAHAAKYGHERYGKTYEGVYKDWKPGQKVHLVGHSMGGQTIRQLEELLRNGNQEEIEYQKKHGGTISPLFKGNNDNMVSSITTLGTPHNGTHASDVLGNEAVVRQVVYDIGKAFGNKDSRVDFGLSQWGLKQKPNESYIDYAKRVKNSKLWKSQDNGFYDLTRDGATDLNRKTSLNLNIVYKTYTGEATHPSLFGRQKADLNMFLPFILTGNVIGKANEKEWRENDGLVSVISSQHPFNQKYTQATDKNQKGIWQVTPTKHDWDHVDFVGQDSSDTVRTREELQQFWHGL

SEQ ID NO: 43398 - protein, 243 aa, Staphylococcus warneri VCU121
MKKTIIASSLAVGLGVVAGNAGHDAHASEANINEAELAQKAQSNDQSLNESPIQEGAYNYTFDYNGFTYHFESDGSNFSWDFHQSGQSSEASNTQAQPQQDVSEQASASTNQTSAEEVSNQQQSNSDQPEQVSAPQTEQTQQPQQEATTSNNESSSNEASSGSSVNVNDHLKQIAQRESGGDIHATNPSTGASGKYQFLQSTWDSVAPSEYKGQPASSAPEHVQDAAAQKLYDTAGPSQWVTA

SEQ ID NO: 43399 - protein, 697 aa, Staphylococcus warneri VCU121
QITGKAEPGSTVTVTFPDGTKATGTTDADGNYVIDIPANEDLKGGETLPVTSTDKDGNQSEPASTVVTDTTAPSVPTVNPVTSNDKTITGKAEPGSTVTVTFPDGSTSTGKADQDGNYVIDIPANEDLKGGETLPVTSTDKDGNTSEPATTVVTDTTAPEAPTVNPVTSDDTQITGKAEPNSTVTVTFPDGTTASGTTDADGNYVIDIPANEDLKGGETLPVTATDKDGNTSDKTTTVVTDTTAPTVPTINPVTSEDKTITGKAEPGSTVTVTFPDGTTATGKTDENGNYVIDIPANEDLKGGETLPVTATDKDGNESQPTTTVVTDTTAPSVPTINPVTSDDTQITGKAEPNSTVTVTFPDGTTATGKTDENGNYVIDIPSNEDLKGGETLPVTATDKDGNTSEPATTVVTDTTAPEAPTVNPVHKGDKTITGKAEPGSTVTITFPDGTTATGKTDENGNYVIDIPAGENLKGGDHIGVTATDANGNTSPSTDGTVIDDGKPVDPSQPTDPTDPGKPTDPSHPTDPTDPGKPTDPSHPTDPTNPGEPTDPSQPTEPTNPGEPTDPSQPTEPTNPGEPTEPGQPTEPTNPGEPTEPGQPAEPTNPGEVTDPGQPTEQPTQGHVSGNNVTSNGTVQQSNHETASTNKGNNHEKDQSELPETGQDGVNKGTLFGTLLAGLGALFLFFKRRREDEEEEEK

SEQ ID NO: 43400 - protein, 176 aa, Staphylococcus warneri VCU121
MMKKGLIATTLAGTVLATGVLTGQAHAAEQKQPIYVFTEKQFNEHRTGETEGFGGGPGSDVGVVMGNETYQQYLQRVKEGQYNAEHSGLPIKYVYPKDAEQNNIQQPNQNNTNMNHQSSTPQTVANAQQQPEQSSQATVLPETGQQTSNSGVILSSILGVIGSAVLLISRKFKQQA

SEQ ID NO: 43401 - protein, 291 aa, Staphylococcus warneri VCU121; identical to SEQ ID NO: 43355

SEQ ID NO: 43402 - protein, 59 aa, Staphylococcus warneri VCU121
MKKSKKRLDFLPNKLNKYSIRRFSVGTASILVGATLLFGINNGAHAAEQNETQSVSQEA

SEQ ID NO: 43403 - protein, 76 aa, Staphylococcus warneri VCU121
MSASSSESTNVSPMHPTSEAQHHDNNKPHSEALPDTGEDDNQSKGLLSGLLSLIFGLAIFRKSRKDKKDRKEDNNN

SEQ ID NO: 43404 - protein, 690 aa, Staphylococcus xylosus
MFIKKHEKFGIRKYKLGAASVLLGTCLAIGLSASGEAKASETMNEETKIDSKHIDSNNQNSVAESENNTSNEIATNSEITAPNDTSLNVNDVQKTESINNDKKIEAAKTLEIGDNTKLEAPSQEDINDRNENAKLDTISDDKAANSDEQTSSNSVPTSSEAPSQNETTQSATTSEQNTLQKNEVSEPNKEETQMSSLENITSPKSTISTYTATNPNLEVANNENVGGKDVSDKITIVNSNIESNDTIRPHNGERSTLKYELTFDEGVKEGDYFDISLSNNVNTRGVSAISKVPEIKNGETIIANGSILEDGKIRYRFTDYVNNRENIKANLSLNLFIDPKTVPRDSNQSIIATINGKETQKDVYVKYLNGINNVGLSVNGSIVSLNKQNNTFTHLAYINPNNFKIPAATVYGQIINGNKQDGNLPSVKVFKVLKPNELNQSVYADTSDTSMFQDVTNDINLNVTNGNYQIDFDNLDSVYVVKFDSTYDGDAQSLTFRTTLSGLSPYYKDYYSQASWDNGVLFYQNNADGEGSDPKPKPEPTPEPEPTPDPEPTPDPEPTPDPEPTPDPEPTPDPEPTPEPEPNIDPSSKDNEIQFSPNDRNNVVKLESQEDTNLNIKAINANTAVKSSQIATDTEAVNSLSKTNTSQHTNEKKQLPNTGEKERSTTMWSSFLLLLGSTLLFFRKKKQEEK

SEQ ID NO: 43405 - protein, 243 aa, Staphylococcus xylosus
MKKTILASSLAVALGVTGYATTADHNQAHASEENIDKAHLADLAQNNPEELNQKPLHAGAYNYNFVLGGNEYTFTSNGQSWSWNYTAAGAQSATSNSVQDVTTQATTNTNETSASEVSAQKQSSNTPVAAVEAPKASSNTQTSAATRTYKVAQTSAASTGGSVKAQFLAAGGTEAMWNSIVMPESSGNPNAVNPAGYRGLGQTKESWGSGSVASQTKGMINYGESRYGSMEAAMTFRASHGWW

SEQ ID NO: 43406 - protein, 434 aa, Staphylococcus xylosus
MPIITDVYAREVLDSRGNPTVEVEVLTESGAFGRALVPSGASTGEHEAVELRDGDKSRYLGKGVTKAVDNVNEIIAPELIEGEFSVLEQVSIDKMMIQLDGTENKGKLGANAILGVSIAVARAAADLLGQPLYKYLGGFNGKQLPVPMMNIVNGGSHSDAPIAFQEFMVLPVGAETFKESLRWGAEIFHNLKSILKNRGLETAVGDEGGFAPKFEGTEDAVETILEAIKAVGLEPGKDVFLGFDCASSEFFEDGVYNYAKFEGENGAKRNAEEQVDYLEELVNKYPIITIEDGMDENDWDGWKVLTDRIGDKVQLVGDDLFVTNTVKLSEGIEKGIGNSILIKVNQIGTLTETFDAIEMAQKAGYTAVVSHRSGETEDTTISDIAVATNAGQIKTGSLSRTDRIAKYNQLLRIEDELYETGKFDGLKSFYNLSK

SEQ ID NO: 43407 - protein, 3271 aa, Staphylococcus xylosus
MGNKQGFLPNRLNKYSIRKFTVGTASLLIGATLVMGIGNEAKADELDSITTDDGSTKDKGEALDISDIKSIEENNATEQDSEEAKNETNDKLTQEKTENSEVESTNEVEQSTVNENSDELIKTEEPKTEETITEQKDSDKTDSTQEQTPSSDNTTNEIVNENETTEEPKTEEVNTSDVSSETETPSTDINKTTETTETTVDENFNSEKDENVEQSQNNNDQQVATKEESEMPKEETTVPEPDKSKVTNTENSENAETPSKLETELATAEDKKATVESFLGSQLSATETKTIMDNADINYETATDEEINIEILKASLIELVNDQESATTLATPTRTMFRTMATPTALAAAVDQSEEVEKSLGYLDNYTFASLIFDPGSLDNPTTLNSNVIPFEIHSYMSGSNSGDRYKIDLKLDPIIAQHVTKITVNPSGRSQPVEFARLTDENGKLTNTWEVNFIRANDGLFGGAEILSQYTATNGKIELDDTVANILNSAGNLENNKLNYQIFVRDSIGNKIVRTSESSGYFLTNADSDLVGLQNNTSSENSNTFKASSGSAAYDDAPGEYGGFLIDQQIMKEGIFSYSKTKSNQWSYNYQIDKDLLPYIESVELHKYDYQGLSGFDKTYHEEDKVADLTLDANGNGSITSDNLNKLIEFNNLLPETVGVRIVIKLNQSVNNILTKDAEYDAQGNLIRETTKQKEDFTFAGYLTDSKGLLINNTLGTSTLALQDYDKDGLLDRYERQVSLSNPENNDTDGDGKNDGDEVINYKTSPLVGKPEAADITNKDTVVTGSVPLKEGAATQTAKVIDGNGKVIGTSTVNSDGTFSVTIPQSTEGTYTIAIDSPNYENDEVNTFNIIDVSKVPAPSINPVDDNDTVIQVNGTAGATTTVRDNNNNEIGSVQIPSDGSTATIVLNKPLTAGTVLTSTASKDGKTSEISDQITVTDETAPEAPVINPITSNDTQVTGKAEPNSSVTVGFPGGGKISVTADDQGNFTVDIPNSVILEGGEVFKAISTDKAGNQSPVAETTVKDMKAPDAPVIGDTTSNSNQVTGTAEANSTVRVIFPSGEVVEVTADENGNFTANIPENEELQGGEEIQATAIDTAGNISQSGSTTVIDATAPDAPQISHVTSVSTEVIGTAEANSTVTVTFPSGTVVETTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADDQGNYTIDIPTNVNLDGGEEIQVTATDKDGNTSSEATTTVTDTTAPEAPTVNEVTSEATQVSGTAEPGSTVTVTFPDGTTATGTADEQGNYIVEIPSNVHLNNGDTVVVTATDKEGNTSEPTNTNVIGTGEAPGTGENPGTGEIPGTGENPSTGEAPSTGENPGTGENPGTGENPGTGEEPGTGENPGTGEEPGTGENPGTGENPGTGEEPGTGENPGAGEAPSTGENSPNASHINDNSNINESQLGASNISSNVVENNKSKDNKTNKQSKLPETGEEETRNATLFGSLFAGLGALLLFAKRRRKKEDEK

SEQ ID NO: 43408 - protein, 573 aa, Staphylococcus xylosus
MKKKNIYSIRKLGVGIASVTLGTLLISGGVTPAANAAQHDEAVDANFDQFNKYGVSDYYKNLINNAKTVEGVKDLQAQVVESAKKARISEATDGLSDFLKSQTPAEDTVKSIELAEAKVLANRELDKYGVSDYHKNLINNAKTVEGVKDLQAQVVESAKKARISEATDGLSDFLKSQTPAEDTVKSIELAEAKVLANRELDKYGVSDYYKNLINNAKTVEGVKALIDEILAALPKTDTYKLILNGKTLKGETTTEAVDAATARSFNFPILENSSSVPGDPLESTCMHVEHDAEENVEHDAEENVEHDAEENVEHDAEENVEHDAEENVEENVEENVEENVEENVEENVEENVEENVEENVEENVEENVSSFAQAPKEEDNNKPGKEDNNKPGKEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 43409 - protein, 492 aa, Staphylococcus xylosus
MKKKNIYSIRKLGVGIASVTLGTLLISGGVTPAANAAQHDEAVDANFDQFNKYGVSDYYKNLINNAKTVEGVKDLQAQVVESAKKARISEATDGLSDFLKSQTPAEDTVKSIELAEAKVLANRELDKYGVSDYHKNLINNAKTVEGVKDLQAQVVESAKKARISEATDGLSDFLKSQTPAEDTVKSIELAEAKVLANRELDKYGVSDYYKNLINNAKTVEGVKALIDEILAALPKTDTYKLILNGKTLKGETTTEAVDAATARSFNFPILENSSSVPGDPLESTCRHASFAQAPKEEDNNKPGKEDNNKPGKEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 43410 - protein, 739 aa, Staphylococcus xylosus
MENKRNKYSIRKFAVGASSILIGSLLFLNVETVKAAEENNQSEVDTQVQSGNHLGDDEHQNLVNDNTNTPVNDDKTQVNDEKDNQATHTSLHKDQQDTNTKVNDSTDKVDPEFNEADKDKEQDQAEVDPEYNAKDKAKEQDQSEVDPEYNAKDKAKEQDQSEVDPEYNAKDKAKEQDQSEVDPEYNAKDKAKEQDQSEVDPEYNAKDKAKEQDQSEVDPEYNAKDKDKEQDQSEVDPEYNATDKAKEQDQSEVDPEYNATDKEQENHVDHKDANQNKMLENSQPALNERVKNDNNIKESTSFDKLPNQTANHDSEQDDDSNPDKALNTLKENAVATPKNQTQQNVEKANEQPNKAAKQGQYKNQDPIILVHGFNGFTDDINPAVLAHYWGGDKLNIRQDLESNGYETYEASVGALSSNYDRAVELYYYIKGGTVDYGAAHAEKYGHERYGKTYEGVYKDWQPGKKVHLVAHSMGGQTVRQLEELLRNGNQEEIEYQKEHGGEISPLFQGNNDNMVNSITTIGTPHNGTHAADALGNEAIVRQLAFDYAKFKGNKNSKVDFGFGQWGLKQREGETYAQYVQRVQNSGLWKTEDNGFYDLTREGAAKLNKNTSLNPNIVYKTYTGESTRPTLFGNQKSDVNLFLPFTVTGNVIGKAAEKEWRENDGLVSTISSQHPFNQAFIEATDEVKKGVWQVTPIKHGWDHVDFVGQDSTDSNHPTEELQQFWHNLAEDLVRNEQFDA

SEQ ID NO: 43411 - protein, 283 aa, Streptomyces albogriseolus
MVNVLDEAAAGTVESAGAKARVVANSLAELKSARTTLQQDATIPGTSWVTDPVSNKVVVTADRTVSKAEWAKLTEVAEGLGTTVELQRTQGEFKPFIAGGDAITGNGGRCSLGFNVTKGGEPHFLTAGHCTEGISTWSDSSGQVIGENAASSFPGDDYGLVKYTADVAHPSQVNLYDGSSQSISGAAEAAVGMQVTRSGSTTQVHSGTVTGLDATVNYGNGDIVNGLIQTDVCAEPGDSGGSLFSGDKAVGLTSGGSGDCTSGGTTFFQPVTEALSATGTQIG

SEQ ID NO: 43412 - protein, 144 aa, Streptomyces albogriseolus
MRNTGAGPSPSVSRPPPSAAPLSGAALAAPGDAPSALYAPSALVLTVGKGVSATTAAPERAVTLTCAPGPSGTHPAAGSACADLAAVGGDLNALTRGEDVMCPMVYDPVLLTVDGVWQGKRVSYERVFSNECEMNAHGSSVFAF

SEQ ID NO: 43413 - protein, 301 aa, Streptomyces albogriseolus
MRIKRTTPQSGISRRTRLIAVSTGLVAAAAIAVPSANAADTPTTFSSSELKSVSSSVLKADVPGTAWAVDSKTNRVVVTVDSTVSQAEINKIKQQAGEDAEAITVKRTPGKFTKLIQGGDAIYASSWRCSLGFNVRSSSGVDYFLTAGHCTDGAGTWYSNSARTTAIGSTAGSSFPGNDYGIVRYTGSVSRPGTANGVDITRAATPSVGTTVIRDGSTTGTHSGRVTALNATVNYGGGDIVSGLIQTTVCAEPGDSGGPLYGSNGTAYGLTSGGSGNCSSGGTTFFQPVTEALSAYGVSVY

SEQ ID NO: 43414 - protein, 255 aa, Streptomyces albus G
MRPRPIRLLLTALVGAGLAFAPVSAVAAPTATASASADVGALDGCYTWSGTLSEGSSGEAVRQLQIRVAGYPGTGAQLAIDGQFGPATKAAVQRFQSAYGLAADGIAGPATFNKIYQLQDDDCTPVNFTYAELNRCNSDWSGGKVSAATARANALVTMWKLQAMRHAMGDKPITVNGGFRSVTCNSNVGGASNSRHMYGHAADLGAGSQGFCALAQAARNHGFTEILGPGYPGHNDHTHVAGGDGRFWSAPSCGI

SEQ ID NO: 43415 - protein, 228 aa, Streptomyces albus J1074
GLAAPGKKELALQLAASADNSTLEGRTLYGYIEDLQDGRGYTAGIAGFCTGTHDLLGLVERYSEAHPDNGLAAYLPALREVDGSDSLEGLEGFPEAWEAEAEVPAFRKAQERERDERYFDPAVRMAKIDGLGTLGQFVYYDAMLLHGPGKGADSFYGIRAAALEKAETKAAGGDERAYLEAFLDARRAVIREGKRFQRDTSRVDSAQRVFLRNGNLSLSTPLTWEIYG

SEQ ID NO: 43416 - protein, 293 aa, Streptomyces albus J1074
MATAAVFLLGPDPEADRVPGESGPSSSAAADGAAESGRDGGPDDADRETEERIAKMPAGLAAPGKKELALQLAASADNSTLEWRTLYGYIEDLQDGRGYTAGIAGFCTGTHDLLGLVERYSEAHPDNGLAAYLPALREVDGSDSLEGLEGFPEAWEAEAEVPAFRKAQERERDERYFDPAVRMAKIDGLGTLGQFVYYDAMLLHGPGKGADSFYGIRAAALEKAETKAAGGDERAYLEAFLDARRAVIREGKRFQRDTSRVDSAQRVFLRNGNLSLSTPLTWEIYGERFHLPG

SEQ ID NO: 43417 - protein, 192 aa, Streptomyces albus J1074
MRRQLAIAAASFTAVLGLAACDTEVTSSPDKPAAAGDAKPGKEADKAEQAEDKETVAKVGDAITLKGFDGEKVEVTVVKVVDPAKSKDEFMAPEDGNRWLGIQFQLVNKGDKAYQDSPTNGMQVADADGQMFQTTFGEITAGPALSSDVRLAPGAKALGWVTFDVPKDVKVSQVQVALNSGMADHTGQWTLQ

SEQ ID NO: 43418 - protein, 192 aa, Streptomyces albus J1074
MLHSRWFKTAGAAAALTLATATAAYATPAPAPAPDLTAAAVTLRYDDSRAAGWEAAIAAGVANWNASVSNVQLVEAAPGTRAEIQIIATSGWPQATLGPVRPGGTARVELGSQAVTEGHDKTRIAAHELGHSLGLPDTKPGPCSQLMSGSTGGTTCKNATPNATERARVQSLYAGGFTFLVPADGRVLVDAP

SEQ ID NO: 43419 - protein, 270 aa, Streptomyces albus J1074
MRAVTRREAGVALLGLAALAACSGEAAGAGGPGLETARKKEIAMRLVSSAENSSLDWRAQYRYIEDIGDGRGYTAGIIGFCSGTGDMLALVERYARERAGAELTGFLPALREVRGSASHRGLGGRFTRAWQRAADGDRAFRDAQDGERDRVYFDPAVARGRQDGLGALGQFCYYDTRVMHGHGDAPGNVGFATIRRRALDTTRPPSRGGDETAYLHAFLDARVAAIAEEPSHTDTSRIDTAQRVFLREGNLRLDPPLVWKVYGDTYRIEE

SEQ ID NO: 43420 - protein, 435 aa, Streptomyces albus J1074
MSVAAAGTGNTAVTGVTARRIIDSRGNPTVEVDVVLADGSLGRAAVPSGASTGAREAVELRDGDPAHWHGKGVDRAVAHVGGEIAAAVRGRDALDQAGLDATLVALDGTRAKSRLGANAVLGVSLATAKAAAASLRRPLYRYLGGEGAHLLPLPMMNIVNGGAHADNPLDFQEFMIAPVGADTFAEAVRMGSEVFHTLRRDLLAAGHSTGVGDEGGFAPSLRTAEEALDFVTAAIERTGYRPGADIGLVMDPASSEFFRDGVYDYAGEGVRRTSAEHAAHLAKLIDAYPVVSVEDPMAEDDWEGWRELTARVGDRCQLTGDDVFCTDEALVREGIRTGVGNSVLVKVNQIGTLTEALATVATAHEAGWTVVVSHRSGETEDTTIADLAVATGCGQIKTGSLSRSDRTAKYNQLLRIEEELGDAARYAGGSVLRRG

SEQ ID NO: 43421 - protein, 296 aa, Streptomyces albus J1074
MRLSLPHSLSRRARLITGATALAASAALVVPAATATAQPAPKTFSATQLNQTADSVRTADVAGTAWYVDAESGKVVVTVDSTVSKAEIAEIKDEAGANAAALEVKHTTGKFSKLIAGGEAITTGGARCSLGFNVQDSAGTKFALTAGHCTNIGSSWSIGTTAGSSFPGNDYGIIRHSNPSAADGRVYLYNGSYQEITGAGNASVGQSVQRSGSTTGLHGGSVTGLNATVNYGADGIVSGLIQTNVCAEPGDSGGALFAGSTALGLTSGGSGNCSSGGTTFFQPVTEALSAYGVSII

SEQ ID NO: 43422 - protein, 484 aa, Streptomyces albus J1074
MTAPARAASLTEVTGFGSNPGNLRMFRYVPDGLPAGRPLVVAMHGCTQSAGGFDDETGWTKWADQWGFALVLPQQQSANNLNSCFNWFEAGDIRRDAGEALSIKQMTDRMKADVGSDPARVHATGLSAGAAMTNVMLAAYPDVFASGAPVAGLPYACATSVVAAYSCMNPGSNLTPAAWAAKVRDAYPGYAGPWPAVSVWQGTTDTTVVPANLTETVEQWTAVHGTDTTPDATGTVGGYPHAVYRDGDGRDVVETYTITGMGHGQPVDPGSGAEQCGTAGAYILDVNICAAYHIGRFWGLAEDGGGTDPGTPAQRAVIPSTAADDGYVKASASGTGAAVGALEGTMGAAVGRGTDGQHNRTLLSFDTSAVPDDATITRAYVTVSRAGGSGDPWAGGNRLLIDVRSGCFGASCATAADDWAAPATASGAAELARFTSGSADSTAFTEVNRTGPTQLRLRLADAPASTAYLFLRTGAEAKLTVEWE

SEQ ID NO: 43423 - protein, 453 aa, Streptomyces albus J1074
MRHIPLRRRVAAACTGVVAVGALTLAGLTGSATAAPEPRATPASAPDAALLRVMERDLGLTPAEARQRIAGEAAATDIAATLKQRLGASFAGARVTGDGATLIVATTDPAERRTITAAGARAERADHGLAELEAAKAGLDAAAGRRAPEGVPLWYVDTTASRVVLQATDRAAADRFAAAAGVDRALVKVVRASEEPRTYADLRGGDAYYMNGSGRCSVGFPVKRGASQAGFVTAGHCGTVGTTTTGVNQQAQGTFQGSTFPGRDYAWVATNANWTPRNLVNGYGNADVTVAGSTQALVGASICRSGSTTGWRCGTVQQLNTSVTYPQGTVSGVTRTSVCAEPGDSGGSFISGNQAQGMTSGGSGNCSQGGTTYFQPLAPALSAYGLTLVTGNDGGGPGPTDPPTEPGGTWAAGTAYAVGATVTYGGTTYRCLQAHTAQAGWQPPNTPSLWQRV

SEQ ID NO: 43424 - protein, 375 aa, Streptomyces albus J1074
MTNVRQPLPSAPTGSPAATWRAPVSSRHAKGNRMLSGNGRHRRPRQAPAFVVAAGVTGSAIAIPLLGAGSASAADTATWDRLAECESGGAWSTNAGNGYYGGLQVTQELWERHGGLSYAPSADLASRSQQIVVAERILDAEGTAAWATCAPAIGLKQGGESADVNPGVPSDTGTPSASPASPADKGEGKGDTEDEDGKASGKDDKDKSDNKDEKGKGEKKEKGEKGDAASATPSADPTSLPDGYPSATPDEEATEIPDAPSDAPSATPGDDEDSGGGRHRGGTAAEPGSGESREGSGRHASRGDRGDAPDASGAYTVKEGDSLSVIAWLHEVDGGWPALYEANKEIVGDDADHILPGQALDLGSDPAAEKDRIGR

SEQ ID NO: 43425 - protein, 232 aa, Streptomyces albus J1074
MLTNKAKHRRPSKVTRILSLAGVAGVAVAAPLVATGSASAATASEWDAVAQCESGGNWSINTGNGFYGGLQFTPSTWAAFGGTAYASSADQATKEQQIAVAEKVLAGQGKGAWPNCGTGLSNAAYNGGGAEAEKPAEKPAEQPAPQAAPERPEPRADRSEQRTAPAEETVETPTGETVAKGDGEYKVVKGDTLSQIAKAENVEGGWKKLFELNKDVVDNADLIFPGQQLHLS

SEQ ID NO: 43426 - protein, 426 aa, Streptomyces albus J1074
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGTEVYHTLKKVLKRKGLATGLGDEGGFAPNLDSNRAALDLILEAVKEAGYVPGKDIALALDVAASEFYKDGSYEFEGKSRSAAEMTEYYEELVAAYPLVSIEDPLFEDDWAGWNVITEKLGDKVQLVGDDLFVTNPERLARGIEEKSANALLVKVNQIGSLTETLDAVELAQRNGFKCMMSHRSGETEDVTIADLAVATNCGQIKTGAPARSERVAKYNQLLRIEEILDDAAVYAGRSAFPRFKG

SEQ ID NO: 43427 - protein, 215 aa, Streptomyces albus J1074
MRMTRTASALAGLGLAVAAALGSVAPASAAAETSTPRSVAAYEASTENAAATRAFQEAVMKAVAEKRAANPGALAVTVTYDASAAPTFRSQIASSTSIWNGAVSNVRLQEGSNADFTYREGNDPRGSYASTDGHGRGYIFLDYAQNQQYNSTRVTTHETGHVLGLPDTYSGPCSQLMSGGGPGPSCTNAQPDSAERSRVEQLWANGLAEAAAEVR

SEQ ID NO: 43428 - protein, 224 aa, Streptomyces albus J1074
GDAENSGAPGHAARTGSPECACAPFPGMSGHSANSGATGCAAPTGPPECAPSTAASGDPANSGTPGRSTPAGPLACAPAMETSRHSADPGAPSRAAPTGPPCRAPSTGTPGHPADSGTPRTSGSPARTGPPECPPSTREPGPRPNSGTPERAPDAAVPDPVTDAEPSQYPAAPTTPAPGPAAEPSRHTSEPGEAGCELETGPTERAAGPSVPRCRPFPRPCVPE

SEQ ID NO: 43429 - protein, 435 aa, Streptomyces albus J1074
MAVRGRHRRRQQSRINRASLTVTAGGAGLALPLVAAGTADAASADTWAKVAACESSGDWSINTGNGYYGGLQFKQSTWEAYGGGAYAGRADLASKDQQIAVAEKVLDGQGPGAWPACSQKAGLTRGGPAPAAPEAAPAPRPAKAPAATPTTTPQSKAGTAEMYTVVRGDTLSQIAEEQRVKGGWQRLYQANRERVGTDPDLIVPGQRLQVKPGAATPPKDRPAPRAKDRTGPEPTGKQAAEKAAAKAAEAKKAADAKKAAEAKKAEEARKAAAAKKAEEAQKAAAAKKKAEEAKKVSAPSTARFSSPVDAGTGTPYRASGASWSKGYHTGVDFPVPTGTSVKAAASGTVVSAGWGGSYGYQVVIKHTDGKYSQYAHLSALTVRSGQSVQAGQRIARSGSTGNSTGPHLHFEVRTGPGFGSDIDPLAYLRGGGVKV

SEQ ID NO: 43430 - protein, 392 aa, Streptomyces albus J1074
MERRKGPPVRRTTRRTTAARVGLSSLLLAGSWAAFGLTPAATAAPDPAPVASGAVLAGMERDLGLTPAEAKARLAAEKEARAVEKKAQRAAGAAYGGSWFDAEKGALVVAVSDRAAADAVTGAGASVRLVEHSAKTLDAAKERIDGLDAPRGVAGWRVDPQANSVVVSVVGDQADGKAVRGFVERARAAGPVEVETVAAAPETFAAGTVGGDPYYTGNVRCSIGFSVHGGFVTAGHCGPTGQGVRGWDNSTIGSFQGSSFPGDDMAYVSVGNGWWTVPVVLGWGTVSDQLVRGSAEAPVGASICRSGSTTHWHCGTVLAKNETVNYSQGAVHQMTKTSVCAEGGDSGGSFISGDQAQGVTSGGWGNCSGGGETWYQPVNEILGRYGLTLHTA

SEQ ID NO: 43431 - protein, 360 aa, Streptomyces albus J1074
MNHRRIPKRRVAVTGAGIAALVAAGLTFQTANASEPQSAEPRTLSVASAGKLADTLAGDLGKAAAGTYYDAKAKNLVVNVLDEAAATEVEASGAQARIVEHSLTALNDARATLKDRASIAGTSWAIDPTSNKVVVTADRTVEGKELAKLTKVVDALGSKAELKQTKGEFKRFIAGGDAIHGDGGRCSLGFNVVKGGEPYFLTAGHCTEGISSWSETSGGSEIGTTVESNFPGDDYGLVQYTGSTEHPSEVNLYDGSTQAITGAGDATVGQSVTRSGSTTQVSTGEVTALDATVNYGGGDVVEGLIQTTVCAEPGDSGGSLFDGSTALGLTSGGSGDCSSGGETFFQPVPEALSAYGVEIG

SEQ ID NO: 43432 - protein, 299 aa, Streptomyces albus J1074
MRIKRTTPRSSVARRTRLVALAAGLAAVGALATPTAHAGESAAFSSAELTSAAEAVLDTDVAGTAWYVDKAANKVVVTADSTVSKAEIAKIRKAAGGEAGALEINRTEGTFSPLLSGGDAIYSSSSRCSLGFNVRSGSTYYALTAGHCTNGTSTWYTNSSRTTAFGTVAGSSFPNNDYGLIRYTNSSVPASGTVGSVDITRAANPTVGQSVTRRGSTTGIRSGTVTGLNATVNYGSGQVVYGMIQTNVCAEPGDSGGPLYSGSTALGLTSGGSGNCSSGGTTFFQPVVEALNAYGVSVF

SEQ ID NO: 43433 - protein, 143 aa, Streptomyces albus
  subsp. albus
MHRTARLAATISLAAAALALPLAQASAAPQAAPASLYAPSELVLTLAHGTSAADSAPARAVTLSCGPTARGSHPDPAAACAELTAAQGDFDALAGSGQAVCDRRYAPVVITVSGVWQGKRTAYERTFSNECVKNSQGRTVFAF

SEQ ID NO: 43434 - protein, 109 aa, Streptomyces ambofaciens
SLHAPSALVLTVGHGESAATAVPLRAVTLTCAPTASGTHPATVSACAELRGAGGDFDALAADAGVMCTREYAPVVVTVDGVWQGRRLSYERTFANECVKNAGSSSVFTF

SEQ ID NO: 43435 - protein, 280 aa, Streptomyces ambofaciens ATCC 23877
MRHPSPDPARPAGTRRRTVLAMANASLAAVPLLTPPRAAATPARAAGLDDPAKKEIAMRLVSSAENSSLDWKAQYGYIEDIRDGRGYTAGIIGFCSGTGDMLDLVELYTARSPGNVLARHLPALREVDGSDSHEGLDPGYPGDWQRAAGDPEFRRAQDDERDRVYFGPAVRQAQADGLRTLGQFAYYDAIVMHGGGGDRLGFGSIRDRALGRARPPAGGGDEVAYLHAFLDARVWAMKQEEAHSDTSRVDTAQRVFLREGNLDLDPPLDWQVYGDSYHVG

SEQ ID NO: 43436 - protein, 455 aa, Streptomyces ambofaciens ATCC 23877
MRHARRRIVRRVARLAAVGGLLLGGTMVTRAVASEPPGPPTGPHATVRVASGTGAGLVSRLGTSRTAGHWLDADGRPVVAVTDGGTAEEVRRAGAEPKVVRHSMSELRSAASTLRSAPRVPGTAWAFDYRANEVVVRGDSTVSAGDWSRLTGVAEGIGDFVRMERTEGEFTTRLNGAEPIRSTAGRCSAGFNVTDGRSEFILTAGHCGPTGSVWFGDGGGDQVGETVAGSFPGDDFSLVEYADGKAGDGADVVAVGDGKGVRITGLGEPAVGQRVFRSGSTSGLRDGRVTALDATVNYPEGTVTGLIETDVCAEPGDSGGPMFSEGLALGVTSGGSGDCAKGGTTFFQPLPDAMASLGVRLLVSAQEGAAPGAVPSSPAATGGGGGAPGAAAPGASAPVAGVDGSTLLARLTDRRNVGPGLLVVAGSVVALVATRWIRAEQDRKAYRRHYSATWG

SEQ ID NO: 43437 - protein, 495 aa, Streptomyces ambofaciens ATCC 23877
MSHKRIPKRRAAMAAGGVVALGAAAILLPNANASQDGGSAGGTAAPKTLKAADASDLASQLAGLLGDAFAGSYYDAGEQQLVVNVVPGDNNQVIVQAKKAGAKVREVDNSLGELRGGARTLKAEATVPGTAWAIDPRTNKILVTADSTVTGAAWDRVESTVEGLGSGMATIRKSPGTFKTFVSGGDAIFGGGARCSLGFNVTAGDGAPAFLTAGHCGVADDQWSDAQGGQPIATVDQAVFPGEGDFALVRYDDPATEAPSEVNLGDQTVQISQAAEATVGQQVFRMGSTTGLADGQVLGLDATVNYPEGTVTGLIQTDVCAEPGDSGGSLFTQDGLAIGLTSGGSGDCAVGGETFFQPVTTALEAVGATLGGDASGGAGDQAGGEEAGGEEAGDGQAGAGGDAGAGEDAGAGAGDVGDGTGVGGEEAGAGDQAGGEEAGGGDAVGGGEEAGGEEAGDGQAGAGGDAGAGEDAGAGAGDVGDGTGVGGEDGSGLTG

SEQ ID NO: 43438 - protein, 144 aa, Streptomyces ambofaciens ATCC 23877
MRNTARWAATLGLTATAVCGPLAGASLASPATAPASLHAPSALVLTVGHGESAATAVPVRAVTLTCAPTASGTHPATVSACAELRGAGGDFDALAADAGVMCTREYAPVVVTVDGVWQGRRLSYERTFANECVKNAGSSSVFTF

SEQ ID NO: 43439 - protein, 459 aa, Streptomyces ambofaciens ATCC 23877
MVAGHAARSRRAALTALGTLVLTALPSAASAAPPPAPGPQSSAARTLGADRPSAQVLHAMERDLRLTPGQASVRLVNEAEAGTRAGMLRNTLGDRFAGAWVSGATSAELTVATTDAADTAAIEAQGAKAAVVARGLGELRTVKQRLDDAAAAGSQTSETPVWYVDVKANRVTVQATSERAAAAFAEAAGVGGQDIGVRVSANRPRVLEDLVGGDAYYIDGQARCSIGFSVTKDQQQGFATAGHCGKPGATTTGFNQADQGTFQASTFPGKDMAWVGVNADWTATPDVKAQNDQKVQVAGSVEALVGASVCRSGSTTGWHCGTVQQHDTSVNYAEGTVDGLTETTVCAEPGDSGGPFVAGAQAQGTTSGGSGDCTNGGTTFYQPVNPLLSDFGLTLKTTAAEAGTPAPQDNAAADAWAAGRVYETGATVSHSGARYRCLQNHQAQGVWSPESTPALWQRV

SEQ ID NO: 43440 - protein, 442 aa, Streptomyces ambofaciens ATCC 23877
MAVRGRHRRYQPNRINRASLTVTAGGAGLALPLMGTGTADAADVETWDKVAACESTNDWDINSGNGYYGGLQFTQSTWEAFGGTEYAPRADLATKDQQIAVAEKVLDGQGPGAWPVCSQRAGLTRGGDTPDIRPAGDARPGKGTERTAEKSTGKSSGKGKVTGRSGAKPDSVKDVKPQTTPQSRAGKGRMYTVVTGDTLSGIADTQQVRGGWQRLYESNRAAIGADPDLILPGQRLAVRGEGTSTAPRPEQKTAEKPRAAEKPKAKPAEPQQKQQKKKSSPDSGKAEAKTESKAKTETAAKADKATSRHAVVAPVDAPTGTPYHQAGSSWSKGYHTGVDFPVATGTSVKSVAAGRIVSAGWGGSYGYQVVVRHEDGRYSQYAHLSAISVRDGQSVGAGQRIGRSGSTGNSSGPHLHFEVRTGPGFGSDVDPLAYLRAGGVRI

SEQ ID NO: 43441 - protein, 188 aa, Streptomyces ambofaciens ATCC 23877
MHVRTLTGGLAATLLMSLPLLGGQASAAGPSGGSTLPAAAAARILTYDASGSAEFKSAVDRGAAIWNESVDSVELRPAASGQRANIRVLADNGWPRALPGSLGNGTVYIGRQAVNQGYNTVRISSHELGHILGLPDRKPGPCSSLMSGSSAGVPCTNPYPNAAEKAEVEGNFSATSRAPAPRPVLVGD

SEQ ID NO: 43442 - protein, 121 aa, Streptomyces ambofaciens ATCC 23877
MICRRNAHTSETRSSHGRGVRTALVVLFAATALATTGEAVASPSVPLRTDWDAIAACESGGNWRANTGNGYYGGLQFAPSSWAAAGGLKYASRADLATRGEQIAVAKRLARLQGMSAWGCA

SEQ ID NO: 43443 - protein, 227 aa, Streptomyces ambofaciens ATCC 23877
MRISLPLLSTAVGLGLTAAVLGAGPAATAAAPQAPARAAQVGYQPAAGSGEDAAANRAFFEAVIKSVAEKRAAAPSSAAAVTVYYSATNAPSFRSQISRSTQIWNSSVSNVRLAERSSGADFAYYEGNDSRGSYASTDGHGNGYIFLDYRQNQQYDSTRVTAHETGHVLGLPDHYSGPCSELMSGGGPGPSCTNAYPNATERSRVNQLWVNGFKAALDKALQKTSQR

SEQ ID NO: 43444 - protein, 387 aa, Streptomyces ambofaciens ATCC 23877
MRRSRPRYLGLAGLLVFGSLTAVGTLPASAADSPTAPAKPPAASAGLLDAMERDFGLTRAEAEGRLAAERRATALEPTARRAAGDAFGGSWFDAAKGRLTVAVTSDAPATTVRAVGATGAQVRTVEHSARRLDAAKARIDRLDAPAGVSSWRVDPSANTVVVDVVRGERSDNDVQRFVDRAREAGPVTVRSVPSAPRTFAAGTVGGDPYYTGNVRCSIGFSVHGGFVTAGHCGGAGAGVSGWDRSHIGTFQGSSFPENDYAWVSVGSGWWTVPVVLGWGTVSDQLVRGSNEAPVGASICRSGSTTRWHCGTVLAKNETVNYSQGAVRQMTKTSVCAEGGDSGGSFISGDQAQGVTSGGWGNCSSGGETWFQPVNEILNRYGLTLHTA

SEQ ID NO: 43445 - protein, 358 aa, Streptomyces ambofaciens ATCC 23877
MSRRRISAVVTALALAGAVPVLLPATEASAAACSSYPSWTAGKSYNAGDIVRYTNGKAYIAEHANPGYDPIISTWYWEPYACDGGSGTPVGNFVVSEAQFNQMFPGRNSFYTYSGLTAALSAYPGFANTGGDATKKQEAAAFLANVSHETGGLVHVVEQNTANYPHYCDWGQPYGCPAGQAAYYGRGPIQLSWNFNYKAAGDALGIDLLGNPWLVQNDAAVAWKTALWYWNTQSGPGSMTPHNAMVNGAGFGQTIRSINGSLECDGKNPAQVQSRVTKYQQFSQILGVSPGGQPLLLSPAGPVRRVAPGATRRTGGASPPSPARARRRGRRPIGPPGTRPRRPRSRTPPWRRPPRRAA

SEQ ID NO: 43446 - protein, 267 aa, Streptomyces ambofaciens ATCC 23877
MTAATRSRTHGRAATGALAALGLSIGMLMSFGTTGAHAATWPTPNGSQGVSATIAVSGTKDYGMKRLYGTGDLGSGGQGEDQGPILELAPGAVLKNVIIGAPAADGVHCKGSCTLQNVWWEDVGEDAATFRGSSSSNVYTVSGGGAKEASDKVFQFNGAGTLNVSDFAVKNFGTFIRSCGNCSTQYKRTINLNSIEVSWKGSRIAGINTNYGDSATLRNITIVGDSGKKIVPCQKYIGNDDGDEPDSNGSGPDGTHCKYATSDITYK

SEQ ID NO: 43447 - protein, 793 aa, Streptomyces ambofaciens ATCC 23877
MPSPSRSRTRHRARPALFAAAAAVAGLVLAGLPATASQAADQESCRPDGLYRTPGVDVPYCSVYDSAGREKMGADHPRRVIGYFTGWRTGKDGKPAYLASDIPWDKITHINYAFAHVDGGNRLSVGPDGEKNTATGMTWPGVEGAEMDPGLPYKGHFNQLTKFKKQHPDVKTMISVGGWAETGGFFAADGSRVDSGGFYSMATNADGSVNQAGIDTFAASAVDFVRKYGFNGVDIDYEYPTTMKDAGNPLDWTFANGRRAGLVKGYAALMKTLREKLDRAGAADGRHYLLSVAAPSSGYLLRGMETFQVQKYLDYVNIMSYDLHGAWNEHVGPNASLFDDGRDSELAAAGVYSTSQYGGIGYLNTDWAYHYFRGSMPAGRINIGLPYYTRGFKNVTGGTDGLWGKAPSTTCPAGAGLTKCGDGAVGIDNLWHDLDTDGKESPAGSNPMWHAKNLEKGVVGDYVTDYGFPAGTRLTGTYARKYDATLVAPWLWNAEKKVFLSTEDEQSVRAKADYVVDRGIGGTMVWELAGDYAWDAGKGQYVPGSTLTDTMYDTFRTASPYGAERATTDLPAEALDVDVEFGQFPLGDSNYPISPKLKITNNTGTALPGGTEFRFDYGTSAPGNAKDQSGWGTSVVRSDHTGGNVGGLKGDYHRVSLKLPAWQSLAPGASTELDLVYYLPVSTPSNWTVTFGGRTYALKGDLARGTTVVEPGTPTPTPSPTGTPTGSASPSPSPSPTDGTRPCTAPAWDAATPYGGGITVAHAGHSWKAKWWTKGEEPGTTGEWGVWQDLGAC

SEQ ID NO: 43448 - protein, 166 aa, Streptomyces antibioticus
MSTVELNTSAGRIVLELNDAEAPKTVENFLAYVRSGHYDGTIFHRVISDFMIQGGGFTPDMQQKSTLAPIQNEADNGLRNDNYTVAMARTNDPHSATAQFFINVKDNAFLNHTSKTPNGWGYAVFGRVTEGQDVVDAIKGVKTGSSRGHQDVPVQPVVIESAKILG

SEQ ID NO: 43449 - protein, 9 aa, Streptomyces antibioticus
GTLIGQDYK

SEQ ID NO: 43450 - protein, 556 aa, Streptomyces antibioticus
MTSDQRPARLPTHKGKLLAPHRLHRLIPVSVALTTVCAALPSSTAYAADTPPTPHLDAIERSLRDTSPGLEGSVWQRTDGNRLDAPDGDPAGWLLQTPGCWGDAGCKDRAGTRRLLDKMTRNIADARHTVDISSLAPFPNGGFEDAVVDGLKAVVAAGHSPRVRILVGAAPIYHLNVVPSRYRDELIGKLGAAAGKVTLNVASMTTSKTSLSWNHSKLLVVDGKTAITGGINGWKDDYLDTAHPVSDVDMALSGPAAASAGKYLDTLWDWTCRNASDPAKVWLATSNGASCMPSMEQDEAGSAPAEPTGDVPVIAVGGLGVGIKESDPSSGYHPDLPTAPDTKCTVGLHDNTNADRDYDTVNPEENALRSLIASARSHVEISQQDLNATCPPLPRYDIRTYDTLAGKLAAGVKVRIVVSDPANRGAVGSGGYSQIKSLDEISDTLRTRLVALTGDNEKASRALCGNLQLASFRSSDAAKWADGKPYALHHKLVSVDDSAFYIGSKNLYPAWLQDFGYIVESPAAAQQLKTELLDPEWKYSQQAAATPAGCPARQAG

SEQ ID NO: 43451 - protein, 109 aa, Streptomyces antifibrinolyticus
GLYAPSALVLTMGHGNSAATVNPERAVTLNCAPTASGTHPAALQACAELRGAGGDFDALTVRGDVACTKQFDPVVVTVDGVWQGKRVSYERTFANECVKNSYGMTVFTF

SEQ ID NO: 43452 - protein, 302 aa, Streptomyces auratus AGR0001
MRNARTNPHSGVARRTRLIAVASGLVAIGAIAIPTASAQNPAPARTFSAAQLSAAGNAVRAADVAGTAWRVDSATHTLVVTADRTVSPAGIARIERAAGSNADAVRIDRIPGTFRKFISGGDAIYAPSWRCSLGFNVRSGSTYYFLTAGHCTEGKPPWYTSSSHATSIGPTTGSSFPGNDYGIVKYTNTSLSHPGMVGSQDITSAGTPSVGQSVTRRGSTTGIHSGKVTALNATVNYGSGDIVSGLIQTTVCAEPGDSGGPLYSGTKALGLTSGGSGDCTSGGTTFFQPVTEALSAYGVSVY

SEQ ID NO: 43453 - protein, 212 aa, Streptomyces auratus AGR0001
MPSHLAKRSVETLLSVLLVMLGVLGLAGRGVAATGAPAGPPAPDWERIAACESSGRWHINTGNGYHGGLQIDLPTWRAYGGERFAPRADLATRAQQIAVGERIVRDRGLSAWPNCARVTSGDDRTDGGSATAGQESAPSARARQRATPARSLRSVAGPAAPSYVVRPGDCLSVIAARTHAPGGTKALYELNKDTLGKGPDLIYPDQRLWLPV

SEQ ID NO: 43454 - protein, 229 aa, Streptomyces auratus AGR0001
MEFRQASESTARNEFRGQRIRGITAAAVLLAAGVLNLASGAPAEARGGAWDRLAGCESGGNWRIDTGNGFSGGLQLAHSTWHSFGGGAYASRAARASRAQQIQVAERVLARQGWGAWPACSASLGLNSATRHSAPRSSTAHAAPQRHAGAPARGRVRHPQLHEKRHKDGSHRSTGRSLVVNTGDTVSGLAYAHGCDWREFYRLNRKVIGANPHLIFPGMRLVLPRSAGH

SEQ ID NO: 43455 - protein, 347 aa, Streptomyces auratus AGR0001
MIAGAGALALAASATVVLANANASTAPAPTPALAKLTSAAATTLASHLKTDTAGAFYDAKAKKLVVNVVNQAQARAARAKGAEARFVQHTFAQLDSARQTLKSKATIPGTSWGIDPQSNKVVVTADRTVKGAKLDRLTKVAQSLGDKVELRHSKGKFTPFIGGGDAIWGSGARCSLGFNVVKDGQPYFLTAGHCGNEIKSWSDQQGGSAIATTEDSKFPGDDFSLAKYTGDTAHPSEVDLYNGSTQKITKAAEATVGEKVQRSGSTTQVHDGTVKALNASVNYQEGTVDGLIQTDVCAEPGDSGGALFDGDAAIGLTSGGSGDCTKGGETFFQPVPEALKAYGAEIG

SEQ ID NO: 43456 - protein, 644 aa, Streptomyces auratus AGR0001
MRYRFTWPRCVVDSLAACTTIACLATPAAATPHAMAVAQAVPVPPTASHPAPPPVGPTVSTGERPDVQGRPLSPTQLPPLSAKKPPTSSTAATKPTSPKKAECSPGDFGSRTGPELVKAVQAATVECVNTLFSITGTDAHDVFREEQMVTIAGAFKDAAGAYSGDNSKNTLQLVMFLRAGYYVQDNHPDDVGDYGQNLATPMEGALDAFFANPSSKKVTAENGDVLSEVMTLSDSSNEQGRYLKVYKEVLSGYNSSYNDIPSMLAAVNNVYTPLWRGNWNPEYVKAVTADPSIIDTLDKFAHDHLDMLGSENSYLDSNAGMNVARYVEHQALQEKVRPLMKGLLDASKITGKTAPMWVTVAAQADSYDKGKCSYYGVCDLAEQLTKAALPVSHNCDEKHVIKAQKLTDAELGAACDSILKQDTYFHDKVKDNGPIPDQYLSTIQLSVFGSRADYQTYAGAIYGVDTNNGGITMIGDPTKPDNKPMSIMYQRDDDNGFPARIWNLNHEYTHYLDARDDMKGDFTQQTSVADVWWIEGLAEYISYGYRKITDDEAVSEAGKHTYKLSTLFQTTYENSNTTRTYPWGYLAVRYMFEKHPEDVATMLGHFRTGDYQGGYAVYHNIGTNYDADFDAWLTACAAGACKAQ

SEQ ID NO: 43457 - protein, 428 aa, Streptomyces auratus AGR0001
MPSIDVVVAREILDSRGNPTVEVEVGLDDGSTGRAAVPSGASTGAFEAVELRDGDPNRYLGKGVEKAVLAVIEQIGPELVGYDATEQRLIDQAMFDLDATDNKGSLGANAILGVSLAVAHAASEASDLPLFRYLGGPNAHVLPVPMMNILNGGSHADSNVDIQEFMIAPIGAESFSEALRWGAEVYHTLKKVLKERGLSTGLGDEGGFAPNLGSNREALDLILEAVKQAGYAPGQDIALALDVAASEFYKDGKYQFEGKDRSAAEMTEYYEELVAAYPLVSIEDPLFEDDWAGWKVITDKLGAKVQLVGDDLFVTNPERLARGIEEGSANALLVKVNQIGSLTETLDAVELAQRNGFKCMMSHRSGETEDVTIADLAVATNCGQIKTGAPARSERVAKYNQLLRIEEILDDAAVYAGRSAFPRFRHGS

SEQ ID NO: 43458 - protein, 238 aa, Streptomyces auratus AGR0001
MARFHEQHGRRPGRAAGLAAAAALTAGTAVMLTAPVAHAEVVDVNYQCRTPIGNKGAVSPIDIRSTPSGGGYKLVMSFQKGVSASPVELGKGAMKPSALISLGGAQSGTVPVAGPPNDKAIPANTPIKISDLSGTYTPKGSGKVTFTAGTLTIKALGTTTTCTPSNHPKPSLTLDVKGTGGSGGSQEGGSATGGGSSGAQLPQTGPADSAVALGTLGGTVLLAGAAGVLWLTRRHQRA

SEQ ID NO: 43459 - protein, 222 aa, Streptomyces auratus AGR0001
MRSPKTALSAALGLGLAAALAAAAPVSATTPSSPANSHHSTPASIAAYQGSAAEKADTKAFFEAVIKSARAKMKAHPGAATVTVTYDAGAAPTYKSQIAESTSIWNSAVHNVKLQEGSGGDFQYKEGDDPRGSYASTDGHGKGYVFLDHKQNQEYNSTRVAAHETGHVLGLPDHYEGPCSELMSGGGPGTSCQNTQPDANERAKVDQLWANGLAGIRLGKAS

SEQ ID NO: 43460 - protein, 340 aa, Streptomyces auratus AGR0001
MALIAATLTLQSAEAAPARGPDPQSADAAVQRAKAISAALGARGAGAYYDAGKHRLVVNVTDKAAAGTVRVAGAEPKVVKHSLAALDAARATLKRKATIPGTSWAMDPKTNRVVVVADRTVQGRKLRQLTKVVSALGDRAALHRSAGRLQPLIAGGDAIWGSGARCSLGFNVTKGGKPYFLTAGHCTSAMRNWSDEQGGPEIAVSDSSSFPGDDYGLARYTDDDIEHPSEVDLYDGDTQEITEADDPIVGQHVERSGSTTHLREGDVLAVDATANYQEGTVDGLIQTSICAEAGDSGGALFDDETALGLTSGGRGDCATDGQSYYQPVREALKDTGAHVG

SEQ ID NO: 43461 - protein, 149 aa, Streptomyces auratus AGR0001
MFVMRYITGAVALGAALVLGGLATSAQAVAAPAQSGRSGGLYAPSELVLTVGQGASRATATVQRAVTLTCMPKAGGSHPNPIAACDQLRTVAGDFNAVTAAPSQRLCTKEWAPIVVTADGVWQGKRVSYSYTFANPCAMTDGRGSVFDF

SEQ ID NO: 43462 - protein, 776 aa, Streptomyces auratus AGR0001
MPRSILLVASLAASLALPSVQPARAAVSHPSVLPARPHQAQPSAKRPSVPTDNPFDHVQRLARAPKFAAAPVPAPRSLVGRDGIPGPQTRPPTAPHQGRSAVAPCTLDGITGLSPERFADFLADPAVTADVCLRSLLWTWDPRLIPVMSDAHVQAVARRITGLAAAHDGKNAGHLYEMFTYLHAVAYQDFSHDEIDTTDAPTVDAVRRAVDAFGTAARTFDVTRTNADTLREALYAASAPGLRQHQLDLIERVLATMDPAHTATHKDPAWGNAALAALSVNYLGVYPGNKDTAFQYAAATDPGYRAVFKAFAKYTHLKDTPNAWVVRDALGEYGRFGEIASLKRAIIADLGALLGPVVQNFGDGSEPWAKVASWLNYFNACKPYAVCKEDIEKRIFPRTYSYDNGGIKVRTALDRAVVDQLYYASKQVRAQFHRVIGTETPLAGDPNTTLTIVLYASRRDYEVYHPLLTGMGTNNGGVYIEQGATFYTYQRRVPQDSSLTLEELFRHEYTHYLNGRFAVPGFFGEGPWYQGDRTTAMDEGSAEFFDGSTRDHGIAVRKSLVRDIIADTAGGKPRMTVNQLLHATYDGDGFRFYSYAGTFFEFLWRQYPAKLQEMYRHLREDDPAAFDDWRNRMGSDAGLQQQYDAFLDTQIAHLDDLYVPNTAFTPNGSLKFATPDEVRSAFAAATANTPTCKDEGDPGMGRFLCTGRITANLGNSGSPDQIFKDMSDTVDYFILERTKPAGNNFNDMNCSFGPTDVWSSGRAGTADFSCEGPLRR

SEQ ID NO: 43463 - protein, 543 aa, Streptomyces auratus AGR0001
MNKRTGAIAGAAAVAIAGAAILLPNANASQDQPAAPKTLSAHSATQLAASLKADLGDQSAGWYLDSGNGHLVMNVLSKDDAASVTAKGAVAKVVQNSLTALKAGAKTLRDNASIPGTAWSIDPKTNKIVVVADRTVTGAKMATLSKTTGGMGAGMVTVKRSQGEFKRYDGGEAGGAAGGGAGQAAGGAGDSGGAAAAGGAGNAASGGAANSGGANSGGGGQAAGGAGDAGGAGGGGGQAAGPVGGSAIFGGNARCSLGFNVTVKGAPAFLTAGHCGNDSKTWTADQGGSQPLGTVADSKFPKTDFALVKYDDAAAKPESSVDLGNGSTQKITKAAEAAVGMKVQRSGSTTGVHDGTVTGLDATVNYGNGDIVNGLIQTDVCAEPGDSGGSMFADDSAVGLTSGGSGDCTQGGETFFQPVTDALKATGAEIGAGGGAAGGGDNGAGGDKGAGGANGAGGANGAGGSDAGAGNAGAGNAGAGSAGAGSQDPGAAGGAQDPGTGANDPGAGAQDPGTGAQDPGTGAQDPGAAGSGDAGAGSGDSLN

SEQ ID NO: 43464 - protein, 221 aa, Streptomyces auratus AGR0001
MLINKGKHSRRSKAVRVATLAGIAGAAVAVPLMGATSASAASVSTWDKVAQCESGGNWSINTGNGYYGGLQFSNSSWAAAGGTQYAPRADLASKSQQIAAAEKLLAIQGPGAWSCAGAGNLTAGGPAANVDTSGSSAQTKSAPQQDTKTEAKKAPAAPEQRASRSTERKSMGHGNYTVKAGDTLAKIAKAHGTSWKSVYEANKSVIGGNPNLILPGQKLNV

SEQ ID NO: 43465 - protein, 388 aa, Streptomyces auratus AGR0001
MERAVSHSQSSHRVARGRRRRRAEHPEALRRLLPRALVVAFLAGGTTAFIAHDKAVRLTVDGTPRTLHTFADDVDDLLADEHLAIGAHDIVAPAPGTALGSGDEIVVRHGRPVVLTIDGQRRTVWTTADTVAGALHQLGVRAEGAVLSADRSRRIEQHGMELAVRTERSVVIVADGREHRVRTNAATVREALAEAGLALRDQDTTSVPPDSFPREGQTISVLRITGSKEVREERLPFRTILRADPRLARGVRSVVQQGRFGVRRVTYRVRTVNGVRQKPKRLHTEIVHAPRPQIVHLGTMVLPTSVRGADHLAWHALAQCETGGRPNAVDASGTYGGLYQFDSGTWRALGGRGRPQDASPQEQTYRAKKLYIRRGASPWPVCGRKLHG

SEQ ID NO: 43466 - protein, 195 aa, Streptomyces auratus AGR0001
MSENSSSPRRFAGSVGLLTSAAAALVLCLPGGAAADGPGGNGTGGNGRGGKGAYACAEDQWPWGCLAECESSGDWHINTGNTFYGGLQFWQPTWEEFGGLEFAPRADLATRDEQIEVAKRVQAAQGWGAWPECARRYGLIEEGGRTHVVRPGETLRKIARKYRVKGGWQALHEANRTTLGDNPNRLIVGTRLRVP

SEQ ID NO: 43467 - protein, 350 aa, Streptomyces auratus AGR0001
MRSGTGRHRRPRQAPAIFVTAGVTGAGIALPLLGASGAHAADTTTWDKVAQCESAGVWSADSGNGYYGGLQLTQEMWDNYGGSAYASRPDLASRAQQIAVAESILDHRGPDVWSSCAASAGLSQGGRAPEVNPGSTSTPEPAPSDGGDSRDPWDQPGSSGMHDGSDSTGTQDEPGDDTDSRPSDEPTESTPSPDAPDTGRTGDPSGKPDPSDAATPGDRHEDPSPSADPSEAGSRPDTSGTPQETPAPGRHRGGADNEAGQGSQGSQGDEGGGRASGGRHASRGGDAHRTGPAADGDYTVRPGDSLSAIATAHRLPGGWSALYDRNEGVIGSDADLIQPGQVLDLGQNAG

SEQ ID NO: 43468 - protein, 794 aa, Streptomyces auratus AGR0001
MLGRAARPSYAAPGPAASAASAGDEFDALRGRWCALTLGTGFDPAAPPYAAALQETGALAGTFRAGMRPAADSLWPDCRYDPPSGITQSYGRLATMAQAYAQPGTGHTGDGGLAEDVLTGLGHLEATVYRTGTTRYGNWWEWQIGSPRLLLDTLAILDEHLPDGLPGALRERCLAAVDHFVPDALLGDYTGTSTGANRVDLCRVVALRGILGRAPAKVALARDALSPVFPYVTRGDGLYADGSFVQHTWVAYSGTYGAVLLDGLGRLFTLLGGSSWQLTDPARQTVFDSVEHAYAPLLHNGLMMDSVNGRAVSRGYLRSDERQIMRSDHYHGHALIAAVALLAEGASAAERARWHALIKGWTARDRVLPVLTDRQYTVADLARLHRIADSSVPAAPEPVGHRLFPAMDRAVHRRPGWAAGLAMASDRITYYENGNGENPRGWHTGAGMLYWWGAEFGGDQYTDAFWPTVDPYRLPGTTVSTKRLADSEGGGWGEPKPAARWVGGTTDGEFAALGQDLRGLASTLTAKKSWFALADCVVCLGAGITARDGVPAETVVDNRCLGESGTAHLTVDGVRQPGTLGATRSFRCAHWAHLAGHGGYVFPGGAPLTTLREARTGSWHDINTTSSPRPFTRRYLTLWHDHGTDPADAGYAYLLMPGAGRRTLAARAADRRWLTVLANDAGRQAIAVERLGVTAANFWHAGSAGPLTSSGPASVLVRERRPGRRPGGGGRTARLCVAAPERSGETLEITWSRPVRAVLGHDPAIEVLAAGPTLRLRLTPGTACATHTCTVRLG

SEQ ID NO: 43469 - protein, 323 aa, Streptomyces auratus AGR0001
MPHSPLRTSRIAALTAALAAVTVAATPSASAAAVPHLKVLSYNTFLMSKTLYPNWGQDHRAQAIAAADFFQGNDVVVLQEAFDNSASDALKSRAAAQYPHQTPVVGRSRSGWDATGGAYSATTPEDGGVTLLSKWPIVHKEQYVYKDACGSDYFSNKGFVYAVLDVNGTKVHVVGTHTQSTDSGCKAGEAAADRAKQLKEVDAFLDAKNIPADEEVMVAGDLNIDSHGDEYPALLGNADLAPADSRTGHPYSFDTQENSIAKYRYPNDPREDLDYVLYRNGHARSAGWQNTVVKEESAPWTVSSWGKDYTYTNLSDHYPLIGG

SEQ ID NO: 43470 - protein, 409 aa, Streptomyces auratus AGR0001
MERRSRKAALWGATVAAVLAAAGPLSPAHAGPRPGPSPSPSPRGMLDAMRRDLGLTAAQVRTRLAQEADAHRSVAAVRRALSAPPAGMWFDKSTGRLVVAVTGAADAQRVRDVGAVPKTVPHSRAALTGLLRRITGRAGDGVPGVTGWGVDERANGVVLRVDRKRRGPRTDAFEHTVRGLGVRAKIPVTVERSDQTPRQQGGSVVGGERWMPGSEGICSIGFTVTGPGDFQGFLTAGHCTLTADQAAYGKDGSRMGTSNKGGGHSVNNREGDFGLVGVDQPGWTVSANVAGQGGTPVTVTGSQEGLVGMSMCRSGQSSGWHCGEITRVDQTVDYGNTVIEGLSFTNACSAPGDSGGSYVTQPNAPMALGMHSGGGPATCGNFGGTTLTIFQPVGEALAKWNLKLKTGSP

SEQ ID NO: 43471 - protein, 96 aa, Streptomyces aureofaciens
DVSGTVCLSALPPEATDTLNLIASDGPFPYSQDGVVFQNRESVLPTQSYGYYHEYTVITPGARTRGTRRIITGEATQEDYYTGDHYATFSLIDQTC

SEQ ID NO: 43472 - protein, 141 aa, Streptomyces aureofaciens
MRIPPRLVALAGAAAVAATLIAGPVAAAAPASHAVAASSAASASVKAVGRVCYSALPSQAHDTLDLIDEGGPFPYSQDGVVFQNREGLLPAHSTGYYHEYTVITPGSPTRGARRIITGQQWQEDYYTADHYASFRRVDFAC

SEQ ID NO: 43473 - protein, 452 aa, Streptomyces avermitilis
  strain ATCC 31267 / DSM 46492 / JCM 5070 / NCIMB 12804 / NRRL 8165 / MA-4680
MSHKRIPKRKAAIAAGSVAALGAAALLLPNANASQTDSGDSTPRTFKSADVSDLASQLASQLGDAFAGSYYNADKQQLVINVVGDDSNVINQIRKAGAVPNQVQNSTSTLQAAAKTLKTDATIPGTAWAVDPKTNEIRVTADSTVKGAKWDTLTATVKSLGSGVATVKKSAGTFKTFVSGGDAIFGGGARCSLGFNVTAGDGSPAFLTAGHCGVAAAAWSDSQNGQPIATVDQATFPGEGDFSLVKYDDPNTQAPSEVNVGNGQTVQISQAAEATVGQQVLRMGSTTGLNDGNVTGLDATVNYPEGTVTGLIQTDVCAEPGDSGGSLFTQDGSAIGLTSGGSGDCTVGGETFFQPVTTALEAVGATLGAGGAAGAGDESAAPGDEATDPAGEATDPAGEATDPAGEATDPAGEATDPADQSGNDGAEQSGNDGADQSGNDGADDGSGLVSSN

SEQ ID NO: 43474 - protein, 144 aa, Streptomyces avermitilis
  strain ATCC 31267 / DSM 46492 / JCM 5070 / NCIMB 12804 / NRRL 8165 / MA-4680
MPNTARWAVTLTLTATAVCGPLAGASLATPNAAASGLYAPSALVLTTGHGQSAATATPERAVTLNCAPTASGTHPAAVSACAELRATGGDFDALSARSDAMCTRQYDPVVVTVEGVWQGKRVAYERTFANECVKNSYGTTVFTF

SEQ ID NO: 43475 - protein, 397 aa, Streptomyces avermitilis
  strain ATCC 31267 / DSM 46492 / JCM 5070 / NCIMB 12804 / NRRL 8165 / MA-4680
MSRGSPMAVRGRHRRYQPNRINRASLTVTAGGAGMAIPLMGTGVAHAADADTWNKVAACESSDNWSINTGNGYYGGLQFTQSTWEAYGGKVYAQRADLATRDQQIAVAEKVLEGQGPGAWPVCSVRAGLTRGGGTPDIDPSGSATHTADRSTKRTVRDVKPQTTPQSQAGTAEMYTVLHGDTLSGIADSRHVRGGWEQLYAANRGTIGADPDLILPGQRLHLRAKATTRTDDASTSTHKSSTSSSKSSTEKASSDRTEKATTSHSLVAPVNAGTGTQYHAAGSSWSKGYHTGVDFPVPTGTSVKAVAAGHVVSAGWGGSFGYQVVLRHADGRYTQYAHLSAISVKAGQSVTADQRIGRSGSTGNSTGPHLHFEVRTGPGFGSDVDPVAYLRAGGVRI

SEQ ID NO: 43476 - protein, 388 aa, Streptomyces avermitilis
  strain ATCC 31267 / DSM 46492 / JCM 5070 / NCIMB 12804 / NRRL 8165 / MA-4680
MRRLRARTPSGRRGPHNLVDRPPTGGRKLKHRRISRRRAAVAGAGIAALVAAGVTFQTANASEAPKTEAPHTLSLSAAGKLASTLGKDLGTDAAGTYYDAKAKHLVVNVLDETAAKTVEAAGAKARVVRNSLAELTSARTTLKQDATIPGTSWATDPETNKVVVTADRTVSKAEWATLTKVVDGLGQRAELQRTKGEYKPFIAGGDAITGGGGRCSLGFNVVKGGQPYFITAGHCTESISTWSDSSGSQIGTNEQSSFPGNDFGLVKYTSNADHPSEVDLYNGSTQPITKAGDATVGQKVTRSGSTTQVHSGTVTGLDATVNYGNGDIVNGLIQTDVCAEPGDSGGSLFAADTAIGLTSGGSGDCTSGGETFFQPVTEALSTFGAQIG

SEQ ID NO: 43477 - protein, 365 aa, Streptomyces avermitilis
  strain ATCC 31267 / DSM 46492 / JCM 5070 / NCIMB 12804 / NRRL 8165 / MA-4680
MLRGPQVERCTAERRPCALRSRGRILPHSACQGHGLSGNRTTGSWLRLTGPIPHVGPPTSPGRERKVRIKRTNPRSGVARRTRLIAVATGFLAAAAFAVPTANASDAQTFSATQLTTVAKSVLKSDVAGTAWAVDPKTNRVVVTVDSTVSKAEIAQIKKDAGSNAGALTVKHTPGTFKKLITGGDAIYGGGYRCSLGFNVHSGSTYYFLTAGHCGEVASTWYSNSGQTTTLGTNVSYSFPTNDFALVRYTNTSVAHPSAVGSQTISSAATPSVGTTVYRRGSTTGTHSGRVTALNATVNYGSGDVVYGMIQTTVCAEGGDSGGPLYGGSVAYGLTSGGSGNCTSGGTTFFQPVTEALSYYGVSVG

SEQ ID NO: 43478 - protein, 196 aa, Streptomyces avermitilis
  strain ATCC 31267 / DSM 46492 / JCM 5070 / NCIMB 12804 / NRRL 8165 / MA-4680
MRPVSRRRDRDRLSVRVRARVGFPYLVVAALAVVLAPAGAVAAPPPPLPGPQAAPVSYECAKDEWPWDCLADCESSGRWDANTGNDFYGGLQFRQPTWEEFGGLTYAPRADLATRKQQIAVAERVLATQGWQAWPACAKRYGLEGRAHVVKAGETLASIARAYDVKGGWTALYQANKEVVGARPDRLKTGTVLLIP

SEQ ID NO: 43479 - protein, 224 aa, Streptomyces avermitilis
  strain ATCC 31267 / DSM 46492 / JCM 5070 / NCIMB 12804 / NRRL 8165 / MA-4680
MSECADSTRKVRTTRTTAVLAGAALLAPLGLLAATGEAAAADSGVWDRIAQCESGGNWHINTGNGYYGGLQFSAGTWRAYGGTAYAATADQASRGQQIAVATKVQRAQGWGAWPTCSARAGAGGSAPAASGTGASGGSSSAGSATTESAASAKQAPSKQSKAPTRAPEHTNRNSSRGDYTVRDGDTLSGIASRHGTTWQKLYAANKTVLGGDPDLIMPGQRLAL

SEQ ID NO: 43480 - protein, 276 aa, Streptomyces avermitilis
  strain ATCC 31267 / DSM 46492 / JCM 5070 / NCIMB 12804 / NRRL 8165 / MA-4680
MTAPSEQRVRHRRRVTKRRAVIGSAAALGLTAGALVTTSLLSSAGAATSWPEATGSKAVSSTIEVSGTYDGKLKKFSGSGDLGTADQSEDQGPLFELEDGAVLKNVIIGTPAADGVHCLGSCTLQNVWWLDVGEDAASFKSKSSSATYKVIGGGAKSASDKVLQFNGAGTLTVTGFQVENFGKLVRSCGNCKTQYKRTVVLSDIDATAPGKALVGINSNYGDTATLSRIRIHGDTKKKIKPCVRFKGNNTGKEPTELGSGPDGTSCKFKTSDVSYE

SEQ ID NO: 43481 - protein, 284 aa, Streptomyces avermitilis
  strain ATCC 31267 / DSM 46492 / JCM 5070 / NCIMB 12804 / NRRL 8165 / MA-4680
MKRAALLLLTAVPAAVAAATAVYLFGLAPSDPDRTESPKPPSRQSSASAQGLNAPAKKELAQEIVASAENSTLDWRSAYGYVEDIGDGRGYTAGVIGFCTGTHDLLTLVERYTKDHPGNGLARFLPALRAVDGTDSHAGLGRAFTAAWRAEAGVAAFRAAQDAERDRVYFDPAVRLARHDGLGALGQFIYYDAMVVHGPGTDPHSLQGIRARALREADTPAEGGSETRYLDAFLDVRRTVMKSEKSHHDTTRIDTAQRRFLYDGNLDLRTPLEWRVYGERYRVP

SEQ ID NO: 43482 - protein, 824 aa, Streptomyces avermitilis
  strain ATCC 31267 / DSM 46492 / JCM 5070 / NCIMB 12804 / NRRL 8165 / MA-4680
MIKPEAIPQYTGNLEQLEKDYGSLKTVAGSIRTTGKDVHSQFQGLSAYYTAPEAEQLFASTKPVADRADGFADDLEKVSGALSSYSTEVRPLVQKLEQLKLDATKFVSSVKGDDDWEYDEDKIDEHNKIRDDVTATVAAFWAAERTCHNAITKLFGGTQMVAGDGSDRKDQYGFNADDLKNAKLPWGDPMEEKHHVWEVGHWVKSFVWDGLIVDGVWGTIKGLGTLVGFGGWDAMGQAWKGLAQLATGLAISSIPGASALFWTLPDDKLPSWLRDSRTAMKETGKALVAWDEWGKNPGRAAGAVTFNVLTTVFTGGAGGAAAGAGKAGAVAKVLSVAGKAGKFIDPMTYVAKGAGAGLSKIGDIAKGLKGIGNIEIPKLPDGSVQLPDGRLLEPNGDLVGPGGVVDTTPVPHEPVLPAHWTIQEPALSGVRAGDGLPGGVAHAGDSLPTGGHYDTSLPSGAADHVPGGTAGHTPSGTAAHTPSGTFDGTPTSYDHTPTATPHDVPTGTPHTGHDLPSGGGHPPEPHGTGHDTPGGHTDDASHGSGHDGPGHGHDGTGHTDDAAHVGDHAGVDHAAVDAAAHHGTDTPVAPGHSGADAAGHGGAGEPFEYEPHMSGDDFEELATDAEKHAVATAELERGTNPAASLSDDAGQAYGDAYWNDYVDNLDPSGREALRTYTGHDYTEINSHLRGENPDVYPETLHTIDEMDRVMGTRPVPEDIMIVRGTGIEHLKLRSPLDMLGNTYGDGAYTSSALGRTVPPAFAWKPVVMHWRVPKGTPALWLDKISKHPGERELLLARGTQYKVTRVFMDEAGKWHVYGEVLPRP

SEQ ID NO: 43483 - protein, 227 aa, Streptomyces avermitilis
  strain ATCC 31267 / DSM 46492 / JCM 5070 / NCIMB 12804 / NRRL 8165 / MA-4680
MRMSTSALAAAAVGLSLATASLSMAVPATAAPVAPAAATAYSGYTGSAAEAKANQAFFEAVIKSVAEKRAAQPRSAAAVTVVYDASRAPSFSSVIARSTQIWNGSVSNVKLQSGSASNADFSYREGNDSRGSYASTDGHGSGYVFLDYAQNRQYDSTRVTAHETGHVLGLPDHYTGPCSELMSGGGPGTSCTNAYPNSAERSRVNQLWVNGFAKALDKALQKAGRQG

SEQ ID NO: 43484 - protein, 511 aa, Streptomyces avermitilis
  strain ATCC 31267 / DSM 46492 / JCM 5070 / NCIMB 12804 / NRRL 8165 / MA-4680
MESDDRSARFWSPDPDALGAVVVSNSQHETYETYGTYGPPYDPYDPYELSYGPAEPPYRMTEPSYGAAEPSYEMTEPSYGTAGPYGPVPEPPGPHTAPTLPYGVYEDTYRPAYESGGSPLPRRTDAAGHPGGRAEARRAARRRKISVRPDPLRRLLPQALVVVFLAGGTTAFVAKDKAIELSVDGKPRTLHTFADDVTELLAEEGVGVGAHDVVAPTRGSALASGDEVAVRYGRPVHLTLDGQRRRVWTTARTVDGALQQLGVRAEGAYVSTSRSRPIGRAGLALDVRTERTVTIMADGRERTIRTNAATVGEAVEQAGITLHGQDTTSVAPGSYPRDGQTVTVMRITGSREVREEVIPFGVERMDDPALFRGTELVERAGQPGARRVTYSLRTVNGVRQTPKRIDSEVVRQPQNRVVKVGTKPPPPSVAGADDLNWGGLAACESGGRPGAVDPSGTYGGLYQFDTRTWHDLGGSGRPQDAPAAEQTYRAKKLYVRRGASPWPHCGSRLHD

SEQ ID NO: 43485 - protein, 319 aa, Streptomyces avermitilis
  strain ATCC 31267 / DSM 46492 / JCM 5070 / NCIMB 12804 / NRRL 8165 / MA-4680
MLSGNGRHRRPRQAPALLVAAGVTGSAIAIPLLGATGASAASGTTWDQVAECESGGSWSADTGNGYYGGLQLSQGNWEKYGGLDYAPSADQASRSQQIAVAEKVLAAKGSSPWSTCGIAVGLSQDSGSADVDTGLLGSGSTADSDSGSGISSGLSDSSSSSGSSSAAKDSKGSAKADATPSGSSTSDSSSADAAKSDDSDKSGQNGDASTPSEAESTSSGRHRGDTADESAADGRADDSTGRHASRGSDGSREAAPDAADDAYVVRPGDSLSAIADSLGLRGGWSALYTENEKTVGADPDVIVPGQSLALAAEPGEKQR

SEQ ID NO: 43486 - protein, 227 aa, Streptomyces avermitilis
  strain ATCC 31267 / DSM 46492 / JCM 5070 / NCIMB 12804 / NRRL 8165 / MA-4680
MLLSSKGKHRRPSKATRAIAIAGVTGAAVAAPLMAAGNASAATASEWDAVAQCEAGGNWSINTGNGYYGGLQFSASTWAAYGGTAYASTADQASKSEQISVGEKVLAAQGKGAWPTCGTGLSGAANNAGSPAPSTPQQSTPKSSTTQSTEQRASRSDERPAAKTVETPTGKKVKKGDGEYKVVKGDTLSSIAEKKHVAGGWQKLFKLNKDIVDDADFIYPGQQLHLS

SEQ ID NO: 43487 - protein, 428 aa, Streptomyces avermitilis
  strain ATCC 31267 / DSM 46492 / JCM 5070 / NCIMB 12804 / NRRL 8165 / MA-4680
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLIIEAIKQAGYIPGEQIALALDVAASEFYKDGKYEFEGKSRSAAEMTEYYEELVSAYPLVSIEDPLYEDDWAGWKVITDKLGDKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAEYAGRSAFPRFRSAN

SEQ ID NO: 43488 - protein, 278 aa, Streptomyces avermitilis
  strain ATCC 31267 / DSM 46492 / JCM 5070 / NCIMB 12804 / NRRL 8165 / MA-4680
MKSSRTSPRFLALALGLGLASSALAVAVPASAQTVATPSDSADTSVAGYDGSAEEAANNKAFFEAVLKSVAEKRAAQPSGQAVTLHYDASKAPSFRSQIASAAATWNSSESNVKLEEASSGADFSYYEGNDPRGSHASTDGHGSGQIFLDYTQAQQNDSIRVVTHETGHVLGLPDNYSGPCSELMSGGGPGPSCTNRYPNATERARVDELWAGGGAQAPGTGSQPAGGPSAAPSAPSAPSVAPGTGNQPAGGPSAALPVRPVGPGQGPWRPHLRTLWN

SEQ ID NO: 43489 - protein, 775 aa, Streptomyces avermitilis
  strain ATCC 31267 / DSM 46492 / JCM 5070 / NCIMB 12804 / NRRL 8165 / MA-4680
MHMTPNRRTFLRAAVLAAGITATVTATGAPSAYADDEYDTLRRRWLVLALGAGYDPTAEPYASRLRRTGELARGYRATMAPAAASLWPGHPFDPPSGITQSYSRLWTMTQAYVQEGTGSTGDAGLLADIVRGLDHVSATVYNPTTTRYGNWWEWQIGSPRLLMDIVAALHDRLSAARRAAACAAVGHFIPDDMLRDYSGTSTGANRVDLCRGVALSGILGRAPDRIALARDALSPVFPYVTQGDGLYADGSFVQHTWVAYSGTYGQVLLDGLGRLFSLFAGSTWDVTDPNRQIILDSVEQAYAPLIHDGLVMDSVNGRAISRGYLKSDDLHVMRGDHFHGQALIAAIALLAGGAGPQERARWHARIKGWIERDDVTPILTAPQFGVADLARLHAVADSGVRAAPEPAGHHLFAHMDRAVHRGRGFAANISMSSERIASYECGNGENPRGWHTGAGMLLWWSGRTDQYTDWYWPTVDWYRLPGTTVSTKRLADRAGGEWGEPKPAVRWVGGVTDGVYAAVGQQVKGLGSTLEARKSWFCVADSVICLGAGITCRDGVPVETVVDNRNLGEGGTQAFVRGHGWAHLEGHGGWVLPAGGELRALREDRTGAWSDINTTSTTERRTRRWQTLWLDHGTDPVDATYAYVLLPGASRAQVAAHAADRHRLSVLANDARRQAVHVGSLALTAANFWSAGTAGPLAASAAASVLVRRRGRTATLCVSEPSRTGQPLEIVWDHPVGRVVRADPAVDIVAAGRRLRVRVTPGMACATHKCEVTLS

SEQ ID NO: 43490 - protein, 146 aa, Streptomyces avermitilis
  strain ATCC 31267 / DSM 46492 / JCM 5070 / NCIMB 12804 / NRRL 8165 / MA-4680
MTKTTMAVPGALLAAIALLSAAPAQAAAHRVTPGNWLYVTVTTGDARSSHISRLLTCDPPHGHAHAARACEELAAADGDITRIPPKRTFCPMIYAPVTADAHGEWNGRHVEYRHAFGNACGLEGETGAVFALSEQASDGPTPGLRS

SEQ ID NO: 43491 - protein, 271 aa, Streptomyces avermitilis
  strain ATCC 31267 / DSM 46492 / JCM 5070 / NCIMB 12804 / NRRL 8165 / MA-4680
MHSPHIRTSRRTLLALIGASLVAGPLVANQSATAAPVGLDDPAKKEIAMKLVSSAENSSLDWKAQYKYIEDIGDGRGYTAGIIGFCSGTGDMLDLVELYTQRKPGNVLATYLPALRNVNGGDSHQGLDPGFPGDWRRAAQDSAFQQAQNDERDRVYFDPAVRQGKADGIGVLGQFTYYDAIVMHGDGGDSTSFSSIRGRALAKAEPPAQGGNEVTYLNAFLDARVWAMRQEEAHSDTSRVDTAQRVFLTKGNLNLDPPLDWKVYGDSYHIG

SEQ ID NO: 43492 - protein, 680 aa, Streptomyces avermitilis
  strain ATCC 31267 / DSM 46492 / JCM 5070 / NCIMB 12804 / NRRL 8165 / MA-4680
MRRSARTAPAALTPLADHVDPAWLPSEAFRALGSRRTVVCGTGALVDTVHGEVAWACGAFGGSVVRAEEPADDRPCDLLLHLGERLDAPEPLGDEGFTLVRRRGRTTVTAAGQRGLLYGLFHVVRLGEAAFGASRAREAHRPALASRMLDHWDNVAVHPVMGQVERGYAGGSLFWRDGRARGDLERVRTYGRLLAACGINAVAVNNVNVHATEAHLLTDRIGEVAEIAGALRPYGIRTQLSVTFAAPLVLGGLATADPLDEAVRAWWAEATGRVYAAIPDFGGYVVKADSEGQPGPFAYGRSHADGANLLADALAPYGGTVHWRAFVYDHRQDWRDRSTDRARAAYDHFVPLDGRFRDNAVLQVKHGPMDFQVREPVSPVIGAMPRTRLAVEVQATQEYTGQQRHVCALAPMWSQVLRWRPEGATGTSVGELARGGLVAVSNAGDDPYWTGHPLAQANLYTVGRLGWQPDADPFGLLDEWIDLTFTPARTEAPERLVAGLRAVLYRSWRTYEKYTAPLGVGFMVQPGHHYGPSVDGYEYSPWGTYHFADRDGVGVDRTRATGTGYAGQYAKPWAEVYESPDTCPDELLLFFHHVPYGHVLHSGRTVIQHIYDTHFEGVAEVEEARQVWASLVDLVEPARHTRVAERYEEQLRGAREWRDHINSYFFRKSGVPDAHGRRIH

SEQ ID NO: 43493 - protein, 904 aa, Streptomyces avermitilis
  strain ATCC 31267 / DSM 46492 / JCM 5070 / NCIMB 12804 / NRRL 8165 / MA-4680
MFHRPASVRRFVTTAVALGLLSTLSTGARAGARTHEPPPRPTTVSSTAGSTTALTGYAIQSTAKVTDPAAAVSSPGYPASGWYPAGARSTVLAALLAGGKYADPFYSTNQQKIPKADFQVPWWYRSDFTVADTSARTYLDFSGVISAADVFVNGRQIARSADVAGAYTRHELDVTSLVREGANTVAFRIQPNNPNKNLTMGWIDWLEPPPDQNMGIVRDVLVRRGGPVALRDAHVITRLDVPSLATADLTVKARARNDSDAAITATVSGSVGATSFRRSVALAAHETKTVTFTPADTPGLHLTSPRVWWPAGMGGQPLYALDLSASVSETVSDTVHESFGIRDVKAPLNSDGARQYSVNGRRLLIKGGGWSPDEFLRWDSTYVEDRLRYALDLGLNTIRLEGHIEPDEFFDLADRYGILTLPGWECCNKWEGNVNGSGSGDEWTAADYPVAKASMAAEAARLRDHPSVVSFLIGSDFAPDAKIEKTYLDALKAADWPTPVVAAASDKSSPVSGSSGMKMTGPYDWIPPNYWYAKREGGATGFNSETSAGPDIPTLDTLRRMMTPAELDTLWKNPGAKQYHRSPSSVFGTLKIYDAALAGRYGAPTGLTDYVRKAQLAQYENVRAQFEAYGRGATDASKPATGVIYWMFNSGWTSLHWQLLDRYLDQGGAYFGAKKANEPLHVQYSYDDRSVVVVNNRPAAVSGLTARVTLFNTDGTQKYDKSATGLSVAGDGAHSTALTLPSSVSGLSTTYLARLVLTDSAGKEVSRNVYWLSTRPDTLDWAHTDWYYTPTTSYADLKGLGSMARVPVSATASTTAGTDGASTTTVTVRNTGSGRTPSLFTDVHLVDSKGKPVLPVQWSDNEVSLWPGESATLTVTYRTADLHGSAPRVRVSGWNTAEQTVPAA

SEQ ID NO: 43494 - protein, 456 aa, Streptomyces avermitilis
  strain ATCC 31267 / DSM 46492 / JCM 5070 / NCIMB 12804 / NRRL 8165 / MA-4680
MVHRHVGAGCAGLSVLATLVLTGLPAAAAIEPPGPAPAPSAVQPLGAGNPSTAVLGALQRDLHLTDTQAKTRLVNEMEAGTRAGRLQNALGKHFAGAWVHGAASADLTVATTHATDIPAITAGGATAVVVKTGLDDLKGAKKKLDSAVAHGGTAVNTPVRYVDVRTNRVTLQARSRAAADALIAAAGVDSGLVDVKVSEDRPRALFDIRGGDAYYIDNTARCSVGFSVTKGNQQGFATAGHCGRAGAPTAGFNEVAQGTVQASVFPGHDMAWVGVNSDWTATPDVAGAAGQNVSIAGSVQAIVGAAICRSGSTTGWHCGTVEEHDTSVTYEEGTVDGLTRTTVCAEPGDSGGSFVSGSQAQGVTSGGSGDCTRGGTTYYQPVNPILSTYGLTLKTSTAPTDTPSDPVDQSGVWAAGRVYEVGAQVTYAGVTYQCLQSHQAQGVWQPAATPALWQRL

SEQ ID NO: 43495 - protein, 183 aa, Streptomyces avidinii
MRKIVVAAIAVSLTTVSITASASADPSKDSKAQVSAAEAGITGTWYNQLGSTFIVTAGADGALTGTYESAVGNAESRYVLTGRYDSAPATDGSGTALGWTVAWKNNYRNAHSATTWSGQYVGGAEARINTQWLLTSGTTEANAWKSTLVGHDTFTKVKPSAASIDAAKKAGVNNGNPLDAVQQ

SEQ ID NO: 43496 - protein, 72 aa, Streptomyces azureus
MDATAIHERWSVMSNASIGQEIGVEGLTGLDVDALEISDYVDETLLDGEDLTVTMIASASCTTCICTCSCSS

SEQ ID NO: 43497 - protein, 113 aa, Streptomyces bikiniensis
SLYAPSAVVLSIGKGDASGPVTVLRATTLSCAPVPGGTHPAPEAACAELKAGFAGGGFGGLLASPDPDRACPQHFDPVTVTLDGVWEGARTSWQHTFSNACVMGTTLDGGEAF

SEQ ID NO: 43498 - protein, 300 aa, Streptomyces bingchenggensis
  strain BCW-1
MRIKRTAPHSKHARRLALVAATSALVAGTALAAPAYAGSDATPKTTAAEAKAAGSAVLEADVAGTAWYVDKATNTLVVTADSTVSQAEIAKIKSTAGANADAIEIKRTPGKINKLISGGDAIYADSWRCSLGFNVRNSSGANYFVTAGHCTDGAGTWWSNSGHSTTIGPTAGSSFPTNDYGLVRYSGSVTPTGNVGSQDITSAANPTVGQTVTRRGSTTGIHSGRVTALNATVNYGGGDIVYGMIQTTVCAEPGDSGGPLYAGTTALGLTSGGSGNCTSGGTTFFQPVVEALNAYGVSVY

SEQ ID NO: 43499 - protein, 357 aa, Streptomyces bingchenggensis
  strain BCW-1
MKHRRISRRRMAVTGAAAVALTAGALSLQTANAAPTPPPPPILSATEAGQTAAALIADLKDGAAGAYYDAEAGKLVVNVLDQTAADQVREAGAEARAVKYSLAQLGAARAVLKDKATIPGTSWSVDPRTDKVVVTADSTVEGTRLDRLNKVADGLGDKVEVRRSAGTFRTFIAGGDAIWGQGGRCSLGFNVVKGGEPYFLTAGHCTEAISSWSESQGGPEIGKNAGSSFPGNDYGLVKYTGDTAHPSQVNLYGGTQSITKAGDATVGQKVQRSGSTTKVHDGEVTGLDATVNYQEGTVEGLIQTTVCAEPGDSGGSLFADDTALGLTSGGSGDCSSGGETFFQPVPEALQAYGAEIG

SEQ ID NO: 43500 - protein, 697 aa, Streptomyces bingchenggensis
  strain BCW-1
MPKPLRLRRSAALAPLLAAALTAALAPPATAAPAAPRAGLPSYISALSSVRYDGADDDLLTAGLGFSGLRAAAPPAPADPDRPTAAELRRQAIWASAGLYAGSGGGLGRLYGPNVDRGRPVPGDGKVAGVEYRAVAGSGSHSVSFVVQVPDDFDRSRPCVVAAPASGLGGVYNMVGTAGAWGLHRRCAVAYTDKGMGPAFDDLHSGTVMAYDGTTGPRAQTADRAAFDAGLSDAERARFDAERPYRVAYKMAHAKTNPQATWGRDVLRSVELALALLDRDWRRGAPRAGYTPATTTVIATGVSNGGGAAVAAGEDDHGGLIDAVVASEPQMNLAPLNGIRVTQGGRAVPAAGLPLIRYGSLASLLQPCAALTEPTAPGYSSLDTAAAHRRCAALVGDDPRLISRRDAKRAGPDGLPRLAQEALVRAGYQPQSSYLQLAHYDPQTPASYAMSFARASVADSLCGYGWARTDASGTPVPYRTAELAAAFGTSSGRAPAPGVLIDENSPGGPVADAKSQGPDGRHDYNLRGESCVYRLAFNTAQEPEWAARLAEGLDATRRTGDLHGKPALIVHGRDDTRVPVNHSSRPYLGLNSRTQHGAGTVAYVEVTNAHHFDSTAPGYDNRYVPLGYYYQQALDVMWQRLTQRGQLPPSQVVRTVPRGGEPGHAPDLTPANVPDIADRPAAGDRVRITDGTVRIPG

SEQ ID NO: 43501 - protein, 430 aa, Streptomyces bingchenggensis
  strain BCW-1
MAARGRHRRPRPRRVSRASLAFTAGGAGVALPLIGVGQASAASVDTWDKVAECESTDNWSINTGNGYYGGLQFSQSTWEAYGGTSFAPRADLASKDQQIAIAEKVLDAQGPGAWPVCSVKAGLTRGGQPADVTPGTASGRTQTAPKATPKATPKATPKATPKTESAPEAAPKATTKAVDQSAAASGRSGSSYTVVGGDTLSRIADTRDVDGGWQRLYEANRRVIGGDPDLIYPGQKLTLDTNRSPAARPRESQPRAERTDQAKQRAEQAAKQRVEQANKARERAKKKSGSAAHSSSSFTSPVASHAVGTAYGVSGSNWSSGHHTGVDFPVATGTQVRAVGSAEVVAAGWGGAYGYQVVLRHSDGMYSQYAHMSALTVHVGQTVSAGQQLGRSGATGNVTGPHVHFEVRTGPDYGSDVNPLAYLRSKGVQI

SEQ ID NO: 43502 - protein, 188 aa, Streptomyces bingchenggensis
  strain BCW-1
MRSSKALRALPAVAVAVLALAGGQAVAAPASGSAQQQVIAARVLTYDSSQAAEFKDAVTKGAAIWNDSVANVELKPVASGQRANIRIIADNGWPRTATTSLGSGTIYFGRQAVDEGYNTVRISSHELGHILGLPDMKPGPCSSLMSGSTAGTSCTNPNPNAAERAEVEDNFAGALASSAATRDLLFVD

SEQ ID NO: 43503 - protein, 326 aa, Streptomyces bingchenggensis
  strain BCW-1
MTNSPASAGTTATSARRRSTPRSVLAALFGGILPLLASLLMLSPSPAAAASLTEVTGFGNNPSNLRMYQYVPSNVAARPAILVAVHYCTGSGPAFFSGTEFASLADRYGFIVIYPSATRSGSCFDVSSPQALRHDGGSDPVGIVSMVRYVLQHNNADPSRVYVTGASSGAMMTNVLLGDYPDVFKAGAAFSGVPFGCFATTDGSGWNTACANGTITKTAQQWGDLARGAYPGYTGARPRMQLWHGTADTTLRYPNFGEEIKQWTNVLGASQTPASTDSPQTNWTRTRYGATGDRAPVEAISIQGTGHSLPLAGMAARAITFFGLDS

SEQ ID NO: 43504 - protein, 399 aa, Streptomyces bingchenggensis
  strain BCW-1
MSRTQGGRRVAGSHRGTGGRADARRAARRRQRAARPEQLRRLLPQALVVAALAGGTSAFVAEDKAVRLSVDGSARTLHTYAGDVAELLADEGVDVGAHDLIAPAPEADLVSGDRIAVRYGRPVTLTVDGERRRVWTTAHTVDGALRQLGVRAEGAHLSVSRSAAISRRGLDLDVRTERTVTFMADGREHTLRTNAATVAAALAEAGIALREQDTTSVPQESFPRDGQTISVLRITGREEVRDRALPFPTFRRADPTVLQGAELVAAVGEPGLERTTYLVRTVNGVRQRPRKLKTRVVRRPVARVVRVGTKPRPPLPVAGAEGLDWQAMARCESGGRPNAVDDSGRHGGLYQLDQGTWQDLGGHGRPQDAPASEQTYRAKKLYVQRGAGPWPHCGHRLSG

SEQ ID NO: 43505 - protein, 949 aa, Streptomyces bingchenggensis
  strain BCW-1
MPALAQPVLGTEPSAATLPAEDGYDLWLRYGQVEDSGQLKRYRAALQSLVWQGGGALQQSAVDELVRGLTGLLGTRVRPRTSAASGAALVVGTPTSSALIRELVPAADLAELGDEGYVVRRVTRRGRDFTVVAAHADRGVLYGAFHLLRLVQTRRPLEHVDLTERPAAPLRMANHWDNKDGSIERGYAGRSFFDWEKLPQLDNRYTDYARVMASLGINGAVINNVNTPADYLAEPFLTKLAALAGVLRRYGVALYVTANFAAPIDLGGLDTADPFDPAVRGWWTRKAEEIYGKIEDFGGFLVKANSEGRPGPLDYGRTHADGANLLAGALRPHGGIVMWRAFVHDSDEKWDRQAYLDFTPLDGKFADNAVVQIKNGPIDFQVREPAHPLFGSLPGTNSMIELQVTQEYTGHATHLCYLVPQWKEVLDFDTLKAGEGSTVARVVTGRVHSYSHFGFAGVMNFGDARNWTGSHLAAANTHGYGRLSWNPDLTAEDLATEWTRMTFGNDLHVVETVSALLRDSWRTYEDYTSPLGTGYLTHPPDGSVTGHLDPSPTTTTQFHKSNREGIGYDRTAATGDGYTKLYAPAIRDAYESLENCPEELLLFLHHVPYTHRLDNGKTVIQHIYDTHFSGAAQVADMRTRWEGLRRRVDHRRFTDVRRQFGEQIARAGQWRDTLVAYWFELSRILDERRSWLQAIVAPADTALLGGERNELPVQVVNATSSGLRTVTTLDLPEGWQSEEATSYVASREGETVRIPVVPPPTPALATLHARPRSGTVQALDSSLRSLAKAVVVPPAARCVHALDAGPDSAPVLKGYTRLSPTSRWQEGAAFGWVGNTPAATDTGLFDVVRRDYVRSGAPTVLRLRLPAGRCTAHLLTGDPNTFNRPLIVRVDGTETARSKQLDGREFTWLRIPLDGGSSGREVDVELSTGEDHTWHLSACVVLADDQERA

SEQ ID NO: 43506 - protein, 431 aa, Streptomyces bingchenggensis
  strain BCW-1
MSSIDVVVAREILDSRGNPTVEVEVGLDDGSTGRAAVPSGASTGAFEALELRDGDKSRYGGKGVEKAVLAVIEQIGPELVGYDATEQRLIDQAMFDLDATPDKSSLGANAILGVSLAVAHAASEASDLPLFRYLGGPNAHLLPVPMMNILNGGSHADSNVDIQEFMIAPIGAESFSEALRWGTEVYHTLKSVLKERGLSTGLGDEGGFAPNLNSNRDALDLIVEAIKKAGYQPGQDIALALDVAASEFYKDGAYTFEGQTRSAAEMTAYYAELVDAYPLVSIEDPLNEEDWDGWKTITDQLGDKVQLVGDDLFVTNPERLARGIESGTANALLVKVNQIGSLTETLDAVELAQRNGFKCMMSHRSGETEDVTIADLAVATNCGQIKTGAPARSERVAKYNQLLRIEEILDDAAVYAGRSAFPRFKGAVLKG

SEQ ID NO: 43507 - protein, 234 aa, Streptomyces bingchenggensis
  strain BCW-1
MRNDKGKHRRPSKVTRIAALAGVAGAAVAAPLLGATSASAATTAQWDAVAQCESGGNWSINTGNGFYGGLQFTNSTWSAYGGTAFAARADLATKDQQIQIAEKVLAGQGKGAWPVCGKNLTTTGTPTPSTSTAQPSKPAAKPAKPAQPAQTAKPAQPAKPKAQPRDESEHAGRGHARHAFKKGDGEYKVKSGDTLSKIADAHHVDGGWKKLFELNKDIVEDANLIFPGQLLHLS

SEQ ID NO: 43508 - protein, 329 aa, Streptomyces bingchenggensis
  strain BCW-1
MTGASIAMPLFGAVGAQAADTTQTWDRVAECESGGMWSANGGNGFYGGLQITLDMWKKYGGQQYAPRPDLASRSQQIAIARAILADRGPDAWPSCALDAGLAGLGDVLDVNPDGKGAPEGAPPSGSWGAKEPTGVGDSDTGESSDNSSRGDRSDGSDGSGSSEDSDTSDKTGKSDPSATPDDKSGEKGGKSGDSGEASRDEDDSASGKGDERSDRDAKGEDSATSPTGRHRGAPDAREQGSAGTADDDARSSGRHASRDDAERAEIPLQPLGREDYAVRGGDGVSDVADDQDGQKADGGAPELYEADESLTGIDPDLVHPGQRLDLSAR

SEQ ID NO: 43509 - protein, 205 aa, Streptomyces bingchenggensis
  strain BCW-1
MHRSIAAAAAVVALTATLTACGGSDGDGDKAGSTKDTRSSGAVEPGGETSPEAAPSSASSTSGKLGDTLSLEGIVGLGESSPHRADITLKKFVDNAKASVGYFEAADGNRLVTVQFTIVNTGETTYSDSGFAESQVVDTAGKTYQGKAGSPTVGDSMTNMLNLVPGKQITGWVLYEVPKDAKISAVTYQMDAMGTNPERTGRWTL

SEQ ID NO: 43510 - protein, 284 aa, Streptomyces bingchenggensis
  strain BCW-1
MPKRIGLVAAAVAVPAALVLTSVGIGQAAEHTPSSAQAVKAEHRTAAVKNLDDPAKKEIAMKLVSSAENSSLDWRAQFKYIEDIDDGRGYTAGIIGFCSGTGDMLELVEYYTQVKPGNVLAKYLPALREVDGSDSHDGLDPNFTKDWKKAAEDKAFQDAQEHERDRVYFNPSVSQGKADGIGTLGQFIYYDAIVMHGPGDSKYSFGGIRKTAMSKAKTPAQGGDEKTYLNAFLDARKKAMQSEEPHSETSRVDTEQRKFLNEGNLGLEPPLKWKVYGDPFEINS

SEQ ID NO: 43511 - protein, 396 aa, Streptomyces bingchenggensis
  strain BCW-1
MLRSHRPALTAGCAIAIAALSLTAIPALATSAAAEPGPTAGAPTGVPTEVPAEMLDAMRRDLGLTADEARARISNEYRAGTATPALRRSLGTAFGGAWVTGKTAELTVATTDQGRHGMITAAGAKAVTVSHSLDDLTAAKGTLDRAAEQRAPSASAAAVWYVDVKSNSVVIQSADPDQASAFVTASGVDRGMVRIVESAEQPKPLDDVRGGEAYYINGTARCSIGFSVSKGSQGGFVTAGHCGEAGATTTGVNKAAQGTFQASRFPGNDYAWVAVNSTWTPKPVVLGPGGSVVTVAGSQEAPVGSSVCRSGSTTGWHCGTVEQLDTSVRYSEGMVSGLSRTTVCAEPGDSGGSYITGSQAQGVTSGGSGDCTAGGTTYFQPVNPILEAYGLTLTTG

SEQ ID NO: 43512 - protein, 389 aa, Streptomyces bingchenggensis
  strain BCW-1
MGSVSIVLPFLGADMAVAAPSETWDKVAECESGGDWDINTGNGYYGGLQFSQHTWEAYGGTKYAARADLATRAQQITVAEAVLRRQGPGAWPVCSVRGRLTRDSRPASGANRGGSGHSAGSGHSAGSGHSTGSRHHSPTPRRHATGSGPYRVVPGDSLSRIAQRESVGGGWKALYRANRRTIGSDPDKIYPGQRLALPSRTGTARTAAAHGKQPQTKQPPTKQPRSARSSHQQAGKTRATTSGTSAHGARRPSAQRRHMTPVSGPLGTSYGVRGPRWASGHHTGVDFVVPVGTGVRAASPGVVVTAGWGGSYGYEVVIRHSDGLYTQYAHLSSLAVRPGQTVDAGLRIGRSGATGNATGPHLHFEVRTGPRYGSDIDPVAYLRSRGVAI

SEQ ID NO: 43513 - protein, 672 aa, Streptomyces bingchenggensis
  strain BCW-1
MPALPSGVDPAWLPPEVFRPLGSRRTLILGTGPLVDTVHGEVAGACARFGGEVVRDARAQGAPYDLVLELGRQGEEGDGLGDEGYALVRAEGVTRVTAAGQAGLLYGLFHLVRLGEAAFEGERARETHRPALALRMLDHWDNVAVHPVMGQVERGYSGGSLFWRDGLARGSRDELERVRCYGRLLAASGINAVTVNNVNVHETEAHLLTDRIGEVAAIADALRPYGIRTHLSVSFAAPVVLGGLPTADPLDAAVADWWAETTGRVYAAIPDFGGYVVKADSEGQPGPFTYGRSHADGANMLAAALAPYGATVHWRAFVYNHRQDWRDRSVDRARAAYDHFAPLDGQFAPNAVLQVKHGPMDFQTREPVSPVIGALPNTRLAVEIQATQEYTGQQKHVCWLGPMWSDALRFRRGGEDGPSVGDLARGGGLVAVSSAGDDPFWTGHPLAQANLYAVGRLAWQPDADPRAILHEWIELSFAPEETADPARLRSGLRAVLDGSWRTYEKYTAPLGIGFMVQPGHHYGPSVDGYEYSPWGTYHFADRDGVGVDRSQATGTGYAGQYAKPWAQAYESPETCPDELLLFFHHVPYGHVLHSGETVIQHIYDTHFEGVEEVEEAHRVWAGLADLVDSARHARVAERYEEQLRSAREWRDHINTYFFRKSGVPDARGRRIY

SEQ ID NO: 43514 - protein, 282 aa, Streptomyces bingchenggensis
  strain BCW-1
MAAVSSLFTAAAVATAGTSAAAAAEASPASVSQAASAIESLNVPGTAWTVDERTGTLRVSVGSTVGGDDLARLDRTAARSGGAVTVERLGGPLRTLLSGGDGAYASAGWRCSVGVNVQSGATYYFITAGHCTDGLPTWYTGADLTTAVGPTTGTSFPGDDYGVVRYANAAVPHPGTVGTVDITGTATAYVGQEVCRRGATTGVHCGRVTSLNATVNYGNGEIVYGLIQTNICAEPGDSGGPLYAGDKIIGILSGGTGDCATGGTTYYQPIQEVLSAYGLTVY

SEQ ID NO: 43515 - protein, 616 aa, Streptomyces bingchenggensis
  strain BCW-1
MNKRTVVIAGAAAAALAGAAVLLPNANASPDKSAEAKTFSSQAAVKLARGLASDLGGNAAGWYYQGDSKQLVMNVLNEDAANDVRAKGAVAKIVANSLTELKATTKTLSDNASIPGTAWSIDPKTNKVRVLADRTVTGTKWATLTKAVDGLAGKATVQRTNGEFKKFDGTDETQPGANGGADQGGADDGAGQGAGQGGADDGAGQGAGQGGADDGAGQGAGQGGADDGAGQGAGQGGADDGAGQGAGQGGADDGAGQGAGQGGADDGAGQGAGQGGADDGAGQGAGDGQGAGDGQGAGDGQGAGGAGEQAGEQAGALDGGDAIFGGGARCSLGFNVTVDGAPAFLTAGHCGNISETWATDQAGAQQVGTTTESQFPVSDFALVTYDDPNTQASSTVDLQDGTTQQITQVAEASVGLAVQRSGSTTGVTDGTVTGLNATVNYGNGDIVNGLIQTDVCAEPGDSGGAMFAEDAAVGLTSGGSGDCTQGGETFFQPVSTALQATGAVIGGGGAGEAGGAATVAAVRAMAPVTARARVTARARVLVTARATALARVPVKAPVTASARAPRAARRKVARPVTTARPAMVTTAPSATVTTVRSATAVATRSVTATPRTTRNG

SEQ ID NO: 43516 - protein, 471 aa, Streptomyces bingchenggensis
  strain BCW-1
MGHTRRRAHRVARLVAIGAVVCGGVMVSQAAADGSPANGSGGDPTRALEARDTRDAQLARTLVDKLGTSRTAGSWIGSDGRAVVAVTDAEAADQVNQAGARAKQVRYSMRQLRSATETLREAPRVAGTAWAVDAMSNEVVVLGDSSVSADQWSRMRGVASAIGGEVRMERTAGSFTTRTLGAEPIFTQGGRCSAGFNVTNGQAGFILTAGHCGPNGTAWFADTQGNTTVGTTVRSDFPGSDFSLVQYQNTSLDQSSVLNIGNGQTVRITGAADPVVGQKVFRSGSTSGLRTGSVTALNATVNYPEGTVSGLIQTDVCAEPGDSGGPLFAQNVALGVTSGGTGDCTSGGVTFFQPVTKALTALGVSLPNAPASDGEAAGTASTAPNNGSDPAAQGAAGGPGGAGGAGGQGGQVSPIIPGTQGDTSSLAGVVAYAQSFGPGLALIGAGLLGFLATLLIRPGRRGYRGYSTRWG

SEQ ID NO: 43517 - protein, 311 aa, Streptomyces bingchenggensis
  strain BCW-1
MRIKHPLHRSGPASRPARAAARLRTAALIAGLAAVFALLAPGAAAADPAQTYSASELKAASDAILAADVGGTAWAVDEDSGSVRVDVDRTVSSSELATLKQAAGPRSGALHIQRTQGRITQLLSGGDPIYSSNGFRCSAGFNVHIGTSYYILTAGHCTNGYPNWSARLGVPIGPTAYSSFPVNDYGYVSYTNPLLPHPSNVYLYNGTYRAITGAGNAFVGMLVQRSGSTTGLHGGTVTGLNYTVNYGNGNVVYQMIRTNVCAEPGDSGGPLFSGNTAIGLTSGGSGNCQTGGVTYYQPVVEALNNHGAAIP

SEQ ID NO: 43518 - protein, 865 aa, Streptomyces bingchenggensis
  strain BCW-1
MSIVPAATLSAVAPPQRAWSQAPREATPAEAAEDQATLIGNTVAVLAGTADSNARPEVAAKLAAIASTAKARLAALDGAGSGELFRGLPLGSSDTNLTTSFQYLYEIALATRTPGGAAPGGDTAVQRRVIDGLVRLHDDYYGDQSKGYYGNWFNWEIGISSHLTRTLVLLKDELTAYRPDLTAICVASMDAYLRNGKAGDVDLDSRFHTGANLADITTNRILQGAVLGDEARITKAVADQLTVLATIDPYHLSHNVTDGFYADGSFIQHASVAYTGSYGKGLLTRMVQAIKILEGTGYAQGEDRVGAVREWVVRGFAPLVFEGWMMEIVKGRGVSRATTTGYTDVAEVVEAVVDLSGYAAGADATALKGYVKFVRQNSRATLDPARFLSPVSVARYADILADTGIPAKDLNPAERHVAFNAMDKTVHRRPGYAFALARSSPRISKYEYMNGENLMPWFQGDGAHYLYLSGQDQTLAFGVDYFTAVSPYRLAGVTAPVETRRTVPELYGGLWYDNPERGFTSSSESQNTYVYFPRGAGGLSGGACLGAYGAAGLVQADDVAYAAQQAGTLPDDFVAYRNARATKSWFMLDDEIVVLAAGVGDPAGRAVTTTIDSRVSRVSRVSRVSRVSRVAQPTDTVTLTGRLRDGTPWSGTGTAPLAWLRYADADQDTAVGYVFLDGRRPTVALETVTRSRRAVRVSNPDTMVTKQVFSVSVEQPAGAPLTSMAYALVPNASERQLMAYAGGPVSVLANTARVQAVRHKGLGLIAVNAFAPGHHHAGHVSVDGPASVILREGGDGTVSVAVADPTTERDTVSVVIRGRALRAGSADEGVRVDRVPGGTRIRVATRHAYGRSFTATLRGRRRAEG

SEQ ID NO: 43519 - protein, 270 aa, Streptomyces bingchenggensis
  strain BCW-1
MAVREPRTKHLNRKRAMAGLLGAVALTTGAVTTGLTLPAASAATWPTPSGTPQAVTKTIPVSGTLDGGMKRYYGSGDLGSGGQNEDQDPLFKLSDGATLKNVILGAPAADGVHCEGSCTLQNVWWEDVGEDAATFRGNGKTFNVIGGGARKAADKIFQFNGGGTLNISNFAGQDFGTFVRSCGNCSTQYKRTINVSNTELTAPGKVGGGINTNYGDSLTLRSITIVGDSSKKIVPCQKYIGNNTGAEPSKNGSGPDGTYCKYSTSDITYK

SEQ ID NO: 43520 - protein, 393 aa, Streptomyces bingchenggensis
  strain BCW-1
MRRTTAVRVGLSALLVLGSLTGAGTALSTAAATPGPESSAPSAKLVSTLGRDLGLTEGQAKTRLRQEAAAMKLAPKAERAAGKAFGGSWFDADTGKLVVGVTGRQQAEAVRATGATARTVRHTAKELDAVKARLDTKARKKAAPAGVSSWRVDPKAGSVVISVRRGSEGDAAVRAFVGAAKNQAGRAGSIPVTVEKAAAQAPSTLAAGTVGGDPYYTGNVRCSIGFSVQGGFVTAGHCSGAGASVNGWDGSYVGNFQGSSFPGNDYAWVSVGSGWWTVPVVLGWGTVPDALVRGSAEAPVGASICRSGSTTHWHCGTVLAKNETVNYSQGAVYQMTKTNVCAEGGDSGGSFISGDQAQGVTSGGWGNCSSGGETWFQPVNEILSTYGLRLHTA

SEQ ID NO: 43521 - protein, 415 aa, Streptomyces bingchenggensis
  strain BCW-1
MALRGRHRRYKPNRISRASLSVTAGGAGIALPLVGAAGASAASGETWEKVAHCESTENWDINTGNGFYGGLQFTQSTWEAYGGTAYAPRADLATKDQQIAVAEKVLDAQGPGAWPNCSGRAGLTRADAAPQSAPKAKAAGASATTHQQADRTPQTKRDTPTPTSLPGRTTAKDSAYVVISGDTLTRIAKRHDVDGGWQTIYQANRTSVGGDPDLIYPGQKLSLNDSGAKVKPKAKPKAKAEPKAEPKAKAKPKAERPSKTAKPDRHHRTAHKPAAKPAGTSEFTAPVSGVSPTTAYRAAGGSWSSGYHTGVDFPVGIGTSVKAVGAGRVVSAGWADAYGYEVVIQHPDGRYSQYAHLSQLSVRAGQQVGGGQQVGRSGSTGNATGPHLHFEIRTGPGYGSDINPLAYLRSHGVSI

SEQ ID NO: 43522 - protein, 212 aa, Streptomyces bingchenggensis
  strain BCW-1
MATLGLGLASTLSAVPASAAAPDSGTVSHTAKSGYVASGESRGDTDAFLQAVIKSVLAKRGVVPGTQAVTVTYSTSRAPSFKSVIARSTQIWNSSVSNVKLQEGSNADFEYREGNDPAGSYASTDGHGSGYIFLDYAQNQQYDSTRVTAHETGHVLGLPDHYSGPCSELMSGGGPGTSCKNSQPNAAEISRVNQLWANGLAGLAKTLEVSAR

SEQ ID NO: 43523 - protein, 550 aa, Streptomyces cacaoi
MPMFRIRLPKPAALIAAGGIGACIATVAVPSAYAAAPAPADSRLGVTASLDRLPSIGERSTLTVNITAETDVKRAGLSLQLPPALRIVDRNPSLAAPTTDPFGQRTSRTLTLTPGTRTIELEVKAVATGPAQIQADISDIDRPDPRRAGHASVELTIGKAKGSTAKGMSVTKADATPVSGPTTPGRPVRPGAAAPAAPSTPPQAAAPGKRYAPVCVSGTLRNRFQSSEGGSWNSKASRDLPVSNANVTLWGRATAGGGTQKLAAGLTGNGDGTFKLCYTPSTSVTSQVWAEFQTQAGTMWSVVDGYNRRYSTTSNALSNVSGNKSLGTVYANSGQSRAWHAFDTLNKLWWDRGSTSTCWTSNQRDGRCTPITVQWYPGSTDGTYWTNRDDKVHLADSDPDSGHTTVHEAGHSLMGKLYNGWWPYVTNCSPHYINRTSSTTCGWTEGFADAVAFHTFKDTVMTWGNGSSMNLANDRGTRGMDWGDACEARVGTALVDLWSQVDGGWTKSNTMMSRERQSTFREYFLTDRPAYGLDSGPKARNILYGHTIQY

SEQ ID NO: 43524 - protein, 110 aa, Streptomyces cacaoi
SLYAPSAVVISKTQGASADAPAQRAVTLRCLPVGGDHPAPEKACAALREAGGDPAALPRYVEDTGRVCTREYRPVTVSVQGVWDGRRIDHAQTFSNSCELEKQTASVYAF

SEQ ID NO: 43525 - protein, 132 aa, Streptomyces caespitosus
TVTVTYDPSNAPSFQQEIANAAQIWNSSVRNVQLRAGGNADFSYYEGNDSRGSYAQTDGHGRGYIFLDYQQNQQYDSTRVTAHETGHVLGLPDHYQGPCSELMSGGGPGPSCTNPYPNAQERSRVNALWANG

SEQ ID NO: 43526 - protein, 195 aa, Streptomyces cattleya
  strain ATCC 35852 / DSM 46488 / JCM 4925 / NBRC 14057 / NRRL 8057
MIKRIAALTALVPAMLSTAVVTPAHSAPRATAAVVTLTYDASDAGQWAGPIEQAVQNWNNAVHNVRLEPASDPSSADYVYEATSGWPQTTLGPIFPGGSGEVQLGQQAVDEGYDATRITAHETGHILGLPDDYSGPCSELMSGHGPGTSCTNAKPDAAEAAQVDENYAAGTPRIRPQHHQVVIDVWSGRVLTNSR

SEQ ID NO: 43527 - protein, 862 aa, Streptomyces cattleya
  strain ATCC 35852 / DSM 46488 / JCM 4925 / NBRC 14057 / NRRL 8057
MRLRIPLPTLMAGFIAGCTAVATLLPTTALAGPGPASAPPAASASRAVPKPLGPVVAAHPADAAPVAAPLPPALLGQAVMGLPAGTAVQTTPRPATREASLAEPAPARPGARPHRTATPAAQSCTPADFGSRGGSSLVSYVKGSTTDCVNTLFDVTGTDAGDIFKEQQMLTVANAFQGLAADYTGDDSTGIWQLALFLRAGYYVQSYNTGAVGDYDATLSNAVKAGLDAFFADPHSADVDDDNGSVLYDVLVLTDSANLQADYLDVYQRVLNGYNNSYNAFPTMANAVNAVLFAPLWRANWNPDFVNAVDADPGIVNTLSGFALHHEDLLGGADSFLDVNAGNDLARMAGDGATTEAVARPEVKAVLDSARITGTTGPLYVHTAYQADAFDGARCSYYGTCDLPAKLTAAVLPHTLVCGNRTIETEALSPSGLAAVCRSLEGEDTFFHTMVKDQGPIPGQYDKTVTLAVFTDQADYVTYSWAIFGNSTDNGGETLMDPTDPNNQAVSVMYQKPWNDGFTANVWNLNHEYTHYLDNIYDLKGSFPTETSVPDVWWIEGVAEYESYAYRGTTDTEAMAEAAKHTYKLSTIFQNTYDNSDTVRTYPWGYLAVRYMFEKHPSDIHAMLGHFRTGDYQGGYAVYHAIGTAYDADFDNWLNDCSQGGCYAPGPTARFSQSVNGATVSLTDNSVETGSSARITSWNWTFGDGTSSTLRNPTHTYSAAGTYVIALTVTDSAGKSASTPASVTVTSGGGSTLPTCADPRTDAMGRNCSRANRATTAGNLDYMYIYLPAGTTTLNVSASGGTGTAYLYYNADTWASPTAFTASSTNPGTTQHITVTNTTAGYRYISLYAKTDFSGVTVSTRY

SEQ ID NO: 43528 - protein, 723 aa, Streptomyces cattleya
  strain ATCC 35852 / DSM 46488 / JCM 4925 / NBRC 14057 / NRRL 8057
MRIRRTARVSSVALACATAVAVALPAAAAPPSPQAHPHPLPAGHAAFTAAPFTTHPAPDVRKRVADQAGKALAAHAAQAHRADGDAFTVRNMVVDANGAADVRYDRTYKGLPTYGGDVVVHLGPDGGYRSLTTGAQTTGAISTTPTLTAGRAAALSRARFHGTIASVAAPRLAVRMSGHSATLVWETVVRGVRPDQTPSALHVFVDAHHGTVLATSDEVDTFAPATTHPAGTTAGHRSVAPATAGTGRSIYSGTVSLDLTQSGGSWSMRDPSHGNGYTTNLDHATSGTGSVFTNSTGSFGDGATDDPASAGVDAHYGAAETFDYYKNVQGRNGIFGDGRGVPSRTHYGNAYVNAFWDGQQMTYGDGQNDARPLVEIDVAGHEMSHGVSGALVGWEENGETGGMNEGTSDIFGTLVEFYANNPVDKPDYTMGELININGDGKPLRYMYQPSLDGQSPDCYDSGNGNLDPHYSLGPLSHWFFLTAVGSGDHGYGNSPTCNNSTVTGIGNDKAGKIWYKALASYANSNENYAQARVDSLRAAADLYGAHCAEYNTVDAAWAAVSVTGSDPVPGTCNSQPGSPVVTGPGNQTGTVGTAVNLPIKATDPAGETLRYSATGLPAGLAIDPATGVVSGTPTTAGTSSVTVTATNTDNRSGSATFTWTISGGGTPPPTGCGNVPAWSAGSGYAPGDEVSHNGHKWLATWYSTGAEPGAPASWAVWEDEGAC

SEQ ID NO: 43529 - protein, 270 aa, Streptomyces cattleya
  strain ATCC 35852 / DSM 46488 / JCM 4925 / NBRC 14057 / NRRL 8057
MTMPPPGTDPGPSPWGPPPPYPGPLLPLTQPRNGLGVAALVVGIVGVFIGFVPFLFWFSGVLGVLGLVFGLVGVGRARNGTATNKGVAVAGSILGGVAVVMAIAGVVLSAIFLKHVAAKVRADEHRRIASAAPADPSADKPLSFGRTRSYEDGVAVTVSQPHRYRLGDIAVGHHKGDLAVQVEITIVNGGHKPLDINGTLPTMRDADGDETDVVYDGDGATKPFAGRLRPGEKAATTFTFSVSPDAADEVRVELSPDIEHDDATWSGRIG

SEQ ID NO: 43530 - protein, 340 aa, Streptomyces cattleya
  strain ATCC 35852 / DSM 46488 / JCM 4925 / NBRC 14057 / NRRL 8057
MRISTVRDATRRLASFVALCLLAALAVTAGDVPGAFAADGTLRQITGFGSNPGNLQMYEYAPAGLPAGAPLVVALHGCTQSADDYYADSGWAKYADLWRFAVVLPQTTTANNLMSCFSWFDPAKDARGVGEAASVAQMTGYALRQYGGDPHRVYVTGLSAGGGMAADLLADYPDVFAGGAIDSGLPAQCAASLTAAYGCQSGDQGLTPAQWGDKVRRSDPGHAGPWPRVAIWQGTADYTVRPVNATELRDQWTDVWGIGQTPSGTVSLPGGTTASVYADGSGRPAVEVYSVAGLGHGLAVHPGSAADACGAVGAYFLDAICSTYYTGLFWGLDGGAVPHR

SEQ ID NO: 43531 - protein, 289 aa, Streptomyces cattleya
  strain ATCC 35852 / DSM 46488 / JCM 4925 / NBRC 14057 / NRRL 8057
MHRHRALRSRGRIALLVAGGVIAAGAVPTAFAATGDTARPASTAAAAHAVAAGAGLDDPRKKEIAMELVSSAENSSLDWKAQYKYIEDIGDGRGYTAGIIGFCSGTGDMLDLVEYYTKREPGNPLAPFLPALRKVNGTDSHAGLGTPFVNAWKKAAQDKVFQAAQDEERDRVYFDPAVARAKADGVRTLGQFIYYDAIVMHGNGDDKDSFGSIRRNALKKAKPPSQGGDETAYLNAFLDARKVAMKDEEAHSDTSRVDTEQRVFLRNGNLDLDPPLKWKVYGDSYSIDH

SEQ ID NO: 43532 - protein, 792 aa, Streptomyces cattleya
  strain ATCC 35852 / DSM 46488 / JCM 4925 / NBRC 14057 / NRRL 8057
MAAASPSRRTFLAAVSGAALALGAPSVGHAAAGDEFDTLRLRWRDLILGTGYDPAAQPFAGALAALGATAAGYHAAMAPAAGSLWPDLPLAANSAHITSSWARLNAMAQAWAQPATGHTGDAELVAAVAKGMDHLYDQVYNERTSPYGNWWDWQIGSPRLSLDTAVLAHDALTAGQTARCVRAVDHFVPDSAVASYSGTSTGANRTDLCRVLAVRGLLGRTAAKLALARDALSPVFPYVTSGDGLYADGSFVQHTYVAYTGTYGEVQLDGLARLFALLAGSSWQVTDPARGHVFDAVEHAYAPFLHDGLVMDVVSGRAVSRGLAAGDPGGVPADDHLRGHAIMAHIVMLADSAGAARRDRWYGLVKGWVARDTYRPALTDPGLGVADLARLATAARSRVPARPEPVGHRLFAAMDRAVHRRPGWTAALSMCSRRIAYYETGNGENPCGWHTGDGMLTWWAGERGGGQYSDGFWPTVDPYRLPGTTVSRKRLADGAGGEWGAARPDTDWAGGTTDGEFAVTGQHLEGLDSTLTARKSWFWLADEVVCLGAGITCRDGTGMETVVDNRDLGAHGTPVLTVDGVRQPGAQGWTATFRHARWAHLDGHGGYLFPGGTRLSALREERTGTWRRINPGGSTEPVTRRYLTLWTPHGTDPSGAAYAYVLMPGASRDATAARAADRGHLRLLANSGRRQAVEVPALGVTAANFWTAGTAARLTVTAPAGVLLRRTGATARIHLAAPDRTGTPVRLRWAHPVRRVLSAGPGVEVVRTAPALEIAVDPGTACATRTVVVRTG

SEQ ID NO: 43533 - protein, 578 aa, Streptomyces cattleya
  strain ATCC 35852 / DSM 46488 / JCM 4925 / NBRC 14057 / NRRL 8057
MHVFRKGRQANRPLTAALSVLALAAGAVGALAGAASAGAAPAPAAAAAPAAASSGGVKIAYYDQWSVYGNAFYPKDLDTRGIAGKLDILNYSFENIDPSNLTCFEATKASDASNESDPNAGDGAGDAFADYQKSFGADISVNGQADTWNQPIVGNFNQLKELKAKYPKLRIVASIGGWTYSKYFSDVAASDASRKKFVSSCIDMFIKGNLPVQGGYGGPGSAAGIFDGFDIDWEYPGSPGGHVGNHYSTADKANYTALLAEFRSELDAYGAAGNRKMLLTAAMPAGQDKIAQIQTDKVGQYLDYANVMTYDMHGAWDATGPTNHQDPTYSSPDDPSKAVDPGTEKYSTDNAVKAWTTGDAAYGIAGGFPAAKLTMGYPLYYRGWTGVPAGSNHGLYQSATGPASARSLSQTAGTAYYKELTGIVDNPADTFYDPKTGSNWFYNGTEFWTGLGAQSIQAKADYAHCHGLGGSMMYSLLDLDTSATLFNKIVDATNGSAASCSSTPTPTPTPTPTPTPTPTPTPTPTPGTCTAAAWDKSAVYTAGNTVSYNGHTWQAKWWTQGEVPGASQWGAWQDLGAC

SEQ ID NO: 43534 - protein, 415 aa, Streptomyces cattleya
  strain ATCC 35852 / DSM 46488 / JCM 4925 / NBRC 14057 / NRRL 8057
MQRRRLRTLAAVVSTAALSVAASTAVAATTEAAPTTAAAQSAAQPAAIGNNWFAAAPYLMPLDNDPPDPGQVMDATGLKAFQLAFILAPNGGGCSPTWDGTSPVASDTAVAGVISQIRAKGGDVSASVGGYAGTKLGQACGTPEATAAAYQQVVDKYGLKALDFDLEEPEYENSAAVHNEIGAARILQQKNPGIYISVTTAGTADGTGWFGKQMLNEAKSQGFVPDNFSIMPFDGGFSGAAAQTSALTNFNTVLQSTFGWDSATAYAHEGISQMNGRSDSGEYFYQSDFQAVLDYATSHHMARFTNWSVNRDRQCTPPDNNGKTSGTCSSVPQSPWDFTKFLVKFAGATPPTSPTPTPPPTSPGQCTAPAYSPTAVYVGGNEVSYNGHTWKAKWWTQGEAPSTGGSGVWQDEGPC

SEQ ID NO: 43535 - protein, 427 aa, Streptomyces cattleya
  strain ATCC 35852 / DSM 46488 / JCM 4925 / NBRC 14057 / NRRL 8057
MPSIDVVVAREILDSRGNPTVEVEVGLDDGSTGRAAVPSGASTGAFEALELRDGDKARYGGKGVEKAVLAVIEQIGPELVGYDATEQRLIDQAMLDLDATPDKSSLGANAILGVSLAVAHAASEASDLPLFRYIGGPNAHVLPVPMMNILNGGAHADSNVDIQEFMIAPIGAESFSEALRWGAETYHALKGVLKERGLSTGLGDEGGFAPDLESNRAALDLIVEAIKKAGFQPGQDIALALDVAASEFYKEGVYVFEGKERTAAEMSAYYGELVDAYPLVSIEDPLHEEDWDGWKTITDQLGDKVQLVGDDLFVTNPERLQRGIDSNTANALLVKVNQIGSLTETLDAVELAQRSGYKCMMSHRSGETEDVTIADLAVATNCGQIKTGAPARSDRVAKYNQLLRIEEILDDAAVYAGRSAFPRFRNQ

SEQ ID NO: 43536 - protein, 224 aa, Streptomyces cattleya
  strain ATCC 35852 / DSM 46488 / JCM 4925 / NBRC 14057 / NRRL 8057
MGKHRRASKAVRIATFAGVAGAAVAAPLLSATSASAASVSVWDRVAQCESSGNWSNHDTGGNGHYGGLQFSPSSWAAAGGLKYASRADYATKDQQIAVAEQLLKMQGPGAWQCAYAGPLTSGGPAPAVDTAGSGNAASAQTDAVKPAKPAAPAPTQHRHAPRHAAPAAPVQRGTGEYTVQAGDTLSKIAADHQVAGGWQKLFDLNKDVVKDANLIFPGQHLHLR

SEQ ID NO: 43537 - protein, 335 aa, Streptomyces cattleya
  strain ATCC 35852 / DSM 46488 / JCM 4925 / NBRC 14057 / NRRL 8057
MLRSGNGQHRKPRQAPRIVVAAGVAGAGMTLPLLASGGAQAASTGTWDRVAQCESGGAWSADTGNGYYGGLLLTQSEWEQYGGLSYAPQPDLASRQQQIAVAEKILAARGVSAWQDCAADAGLTQGGAPAAVDPGVPQTGDGTASGTTRTHDDPPARPSDGPQDTGPDTGPSAPSSSSSASSPTPSASASTAPSGTPSASPTPSGTASSSASPTPSAGSPTTTPSGSPTPTGRHAKPPVPDTTAQAPQETPSAPATGDRGGDDETSRGGSHARPTVPRQGDTSAAYTVRPGDNLSQIATDHSVTGGWPALYDANKSVVGSDPDLILPGQHLTLGH

SEQ ID NO: 43538 - protein, 353 aa, Streptomyces cattleya
  strain ATCC 35852 / DSM 46488 / JCM 4925 / NBRC 14057 / NRRL 8057
MRIKRVTPPAATGRRLRLLAVACGLVAATAVSLPAADAAPAARATPDAAAGVARTLGAAATAGTYYDAAAKATVVNVTSDAAARQVRAAGAVPRLVKYSSAQLDTAGAAVQRLGIAGTAWAQDPRTDQLVVSADHGVPAGRYAALRTTAARYGDAVRVQRVAGRFRELLSGGDAIYGGGYRCSLGFNVHSGGTYYFLTAGHCGKAVSTWYTSSGQSTVIGPTTGYTFPGNDYALVRYSNTSLPHPSAVGGQTITGAGNAYVGESVTRRGSTTGVHSGTVTGLNATVNYGSDGIVRGLIQTNVCAEPGDSGGSLYSGSTAVGLTSGGSGDCTSGGTTFFQPVTAALSHFGVSLP

SEQ ID NO: 43539 - protein, 227 aa, Streptomyces cattleya
  strain ATCC 35852 / DSM 46488 / JCM 4925 / NBRC 14057 / NRRL 8057
MSGHPERHEQNAPATAKKLRRSARAAVLAGAAAVAPLAALGAAGQAHAADSGVWDRIAQCESGGNWHINTGNGYYGGLQFSASTWRAYGGTRYAPTADGASREQQIAVAAKVQSAQGWGAWPVCSGQAGASGSAPGAAGTELKTYKPVTTTHRHHNAPVSRGEQPARPAPTTHRSAGGHGGYTVAPGDTLSTIAEAHGTTWQRLYAANRQVIGGDPDLIMPGQRLTV

SEQ ID NO: 43540 - protein, 348 aa, Streptomyces cattleya
  strain ATCC 35852 / DSM 46488 / JCM 4925 / NBRC 14057 / NRRL 8057
MLAVAAVALPAALLPAAHPARGAAPPEPTPVTQAAALKIASDLTARLGDRAAGVYYDATARQLVVNITDPANADTVRAAGAVPRTVKFTTAQLHQATVTLGEQARIPGTAWAVDPRRNKVVITADPTVTGARRTQLDQAVAQLGEKAVLRQGKAVFRPFIAGGDAIYGGVYRCSLGFNVTKGGASYFLTAGHCGNVAASWSDAQAGQPFATTVDSRFPGTDFALVKYDDPQSTAHPSTVDLYGGGTQQITQAAEATVGERVRRSGSTSQVHEGQVTGLDATVNYQEGTVTGLIDTNVCAEPGDSGGSLFDGASAIGLTSGGSGDCTAGGETFYQPVPAALRAEGAQLP

SEQ ID NO: 43541 - protein, 208 aa, Streptomyces cattleya
  strain ATCC 35852 / DSM 46488 / JCM 4925 / NBRC 14057 / NRRL 8057
MHPLRTTNTQEPARAQDDPSAGRARAACAVALPVTALVAVLGSAGESQAAVPSEVWETIAQCESGGNWHVNNGNGYYGGLQFYQGTWEAAGGLAYAPRADLATREQQIAVAERVVRAQGWQAWPQCAKGVRPPDGDDPRGPEAADRSSHRGPVGRFYVVQSGDTLSGIAARFGVKGGWPALYRANHQAVGSSPDRLAPGATLVIPSGR

SEQ ID NO: 43542 - protein, 436 aa, Streptomyces cattleya
  strain ATCC 35852 / DSM 46488 / JCM 4925 / NBRC 14057 / NRRL 8057
MPGGRTGAHRGTSAWPVPFWATGTWSGAGTGTRRAGPRRAAPPPPVPPAPGPRVPAQPPGSRAAARHARAADRPDALRQLLPRALVVAFLAGGSYTYLAADKTVELTVDGVPRTLHTFADDVPELLDEEHVPVGDHDLVAPGRHAALHDGDTVAVRYGRPLDVTLDGTPQRLWTTARTVEEALRQLGVRADGAHLSASRSATIARHGLRLEVRTERTVTFLADGREHTVRTNAGTVREAARQAGISFGPHDTTSVDPDSFPRDGQTVSVLRITGTTHIREEPVPFRTVVHPDPDEFTGTRVVVTPGRPGVREVVYTQRTVNGVAERPRLVGFRLLRPPVDRVVRAGTRPLPTSVAGADHLNWSGLARCEAGGHPDAVDPSGTYGGLYQFDSRTWHALGGTGRPQDAPATEQTYRAKKLYVQRGAAAWPVCGGRLHH

SEQ ID NO: 43543 - protein, 146 aa, Streptomyces cattleya
  strain ATCC 35852 / DSM 46488 / JCM 4925 / NBRC 14057 / NRRL 8057
MRYTKRALGVMAAAAVCLTGTLAGTATAHAAPARPTSLYAPTELVLTIGKGQTTTNAAVQRAVSLRCTPTPGGDHPAPADACAELNAAQGDFAALVDTHSGRICPDLWNPVVLTAEGVWHGQRVSYSHVYPNACRAQDASRYVFAF

SEQ ID NO: 43544 - protein, 362 aa, Streptomyces cattleya
  strain ATCC 35852 / DSM 46488 / JCM 4925 / NBRC 14057 / NRRL 8057
MRHRRIHTPRIALAGAGAAALAATAVLLPGAGAATAASAHTSATSHAQLSANAARATALVSRLGDRAAGTYYDNAAGRLVVTITDPSAAGSVRSIGAIPRTVKYSAAQLHSATATLAHQARIPGTAWSIDPRQDKVVVTADPSVTGAKRARLDAALARLGDKATLRHVTSRLRPLLAGGDAIWGSDVRCSLGFNVTVNGSPYFLTAGHCGNAASSWSDSQGGGEIGQTVDSHFPGTDYALVQYTDGGDHPSAVDTYDGGSQSISQAADAYVGEQVQRSGSTTGVHGGQVTGLDATVNYEEGSVSGLIDTTVCAEPGDSGGSLFDGASAVGLTSGGSGDCSSGGETFFQPVTAALSAEGATLP

SEQ ID NO: 43545 - protein, 316 aa, Streptomyces cattleya
  strain ATCC 35852 / DSM 46488 / JCM 4925 / NBRC 14057 / NRRL 8057
MAAGVAGAGMTLPLLASGGAQAASTGTWDRVAQCESGGAWSADTGNGYYGGLLLTQSEWEQYGGLSYAPQPDLASRQQQIAVAEKILAARGVSAWQDCAADAGLTQGGAPAAVDPGVPQTGDGTASGTTRTHDDPPARPSDGPQDTGPDTGPSAPSSSSSASSPTPSASASTAPSGTPSASPTPSGTASSSASPTPSAGSPTTTPSGSPTPTGRHAKPPVPDTTAQAPQETPSAPATGDRGGDDETSRGGSHARPTVPRQGDTSAAYTVRPGDNLSQIATDHSVTGGWPALYDANKSVVGSDPDLILPGQHLTLGH

SEQ ID NO: 43546 - protein, 374 aa, Streptomyces cattleya
  strain ATCC 35852 / DSM 46488 / JCM 4925 / NBRC 14057 / NRRL 8057
MTKRRAFVRSAVPTVRRAGPARSGAAVLAVAAVALPAALLPAAHPARGAAPPEPTPVTQAAALKIASDLTARLGDRAAGVYYDATARQLVVNITDPANADTVRAAGAVPRTVKFTTAQLHQATVTLGEQARIPGTAWAVDPRRNKVVITADPTVTGARRTQLDQAVAQLGEKAVLRQGKAVFRPFIAGGDAIYGGVYRCSLGFNVTKGGASYFLTAGHCGNVAASWSDAQAGQPFATTVDSRFPGTDFALVKYDDPQSTAHPSTVDLYGGGTQQITQAAEATVGERVRRSGSTSQVHEGQVTGLDATVNYQEGTVTGLIDTNVCAEPGDSGGSLFDGASAIGLTSGGSGDCTAGGETFYQPVPAALRAEGAQLP

SEQ ID NO: 43547 - protein, 825 aa, Streptomyces chartreusis
MSRIRWRYGTAATALLVAAGLVPTATAHAEDVTDYSITVDPAAKGAAIDDTMYGVFFEDINRAADGGLYAELVQNRSFEYSTDDNRSYTPLTSWIVDGTGEVVNDAGRLNERNRNYLSLGAGSSVTNAGYNTGIRVEQGKRYDFSVWARAGSASTLTVALKDAAGTLATARQVAVEGGWAKYRATFTATRTSNRGRLAVAANDAAALDMVSLFPRDTYRNQQNGLRKDLAEKIAALHPGFVRFPGGCLVNTGSMEDYSAASGWQRKRSYQWKDTVGPVEERATNANFWGYNQSYGLGYYEYFRFSEDIGAMPLPVVPALVTGCGQNKAVDDEALLKRHIQDTLDLIEFANGPATSKWGKVRAEMGHPRPFRLTHLEVGNEENLPDEFFDRFKQFRAAIEAEYPDITVVSNSGPDDAGTTFDTAWKLNREANVEMVDEHYYNSPNWFLQNNDRYDSYDRGGPKVFLGEYASQGNAWKNGLSEAAFMTGLERNADVVKLASYAPLLANEDYVQWRPDLVWFNNRASWNSANYEVQKLFMNNVGDRVVPSKATTTPDVSGPITGAVGLSTWATGTAYDDVKVTAADGATLLSDDFSGDASKWTHTGAGSWSVQDGQYVQTDAAAENTMVQAGDPSWHDYDLHVKATKKSGKEGFLVAFGVKDTGNYYWWNLGGWNNTQSAVEQAVDGGKGTLLTKAGSIETGRAYDIDVKVRGRQVTLYLDGQEWGGFTDDKPAEPFRQVVTKDARTGDLIVKVVNAQPAEARTAIDLGGARVASTARVTTLAADQDAVNTETDAPVTPATSTFSGVTDRFTYTFPANSVTFLRLKQR

SEQ ID NO: 43548 - protein, 328 aa, Streptomyces chartreusis
MCTREAVRMSREHDLPEIPSRRLLLKGAAAAGALTAVPGVAHAAPRPAPYENPLVRQRADPHIHRHTDGRYYFTATAPEYDRIVLRRSRTLGGLSTAAESVIWRAHPTGDMAAHIWAPELHRIGGKWYVYFAAAPAEDVWRIRIWVLENSHPDPFKGTWEEKGQVRTAWETFSLDATTFTHRGARYLCWAQHEPGADNNTGLFLSEMANPWTLTGPQIRLSTPEYDWECVGYKVNEGPYALKRNGRIFLTYSASATDHHYCVGMFTADAGGNLMDPGNWSKSPIPVFTGNETTKQYGPGHNCFTVAEDGRSDVLVYHARQYKEIVGDP

SEQ ID NO: 43549 - protein, 556 aa, Streptomyces chromofuscus
MTSRYRSSEAHQGLASFSPRRRTVVKAAAATAVLAGPLAAALPARATTGTPAFLHGVASGDPLPDGVLLWTRVTPTADATPGSGLGPDTEVGWTVATDKAFTNVVAKGSTTATAASDHTVKADIRGLAPATDHWFRFSAGGTDSPAGRARTAPAADAAVAGLRFGVVSCANWEAGYFAAYRHLAARGDLDAWLHLGDYIYEYGAGEYGTRGTSVRSHAPAHEILTLADYRVRHGRYKTDPDLQALHAAAPVVAIWDDHEIANDTWSGGAENHTEGVEGAWAARQAAAKQAYFEWMPVRPAIAGTTYRRLRFGKLADLSLLDLRSFRAQQVSLGDGDVDDPDRTLTGRAQLDWLKAGLKSSDTTWRLVGNSVMIAPFAIGSLSAELLKPLAKLLGLPQEGLAVNTDQWDGYTDDRRELLAHLRSNAIRNTVFLTGDIHMAWANDVPVNAGTYPLSASAATEFVVTSVTSDNLDDLVKVPEGTVSALASPVIRAANRHVHWVDTDRHGYGVLDITAERAQMDYYVLSDRTQAGATASWSRSYRTRSGTQRVERTYDPE

SEQ ID NO: 43550 - protein, 313 aa, Streptomyces cinnamonensis
MFSLVRSRARTAALALSAVAALAFGTTATTGAAAAPAPAPAPVPAAAKQGPTSVAYVEVNNNSMRNVGKYTLANGGDNVFDVAVIFAANINYDTGTKSAYLHFNENVQRVLDNADTEIRPLQEKGIKVVLSVLGNHQGAGFANFPSQKAASAFAKQLSNTVTKYGLDGIDFDDEYAEYGKNGTGQPNASSFVHLVTALRANMPDKIISLYNIGPAASRLSYGGVDISSKFDYAWNPYYGTWQVPRIALPKSKLSPAAVEIGGTSQSTSAALARRTVAEGYGVYLTYNLDGSDRSADVSAFTRELYGSNAVYTP

SEQ ID NO: 43551 - protein, 110 aa, Streptomyces cinnamoneus
  Streptoverticillium cinnamoneum
SLYAPSALVLTIGQGDSAAAAGIQRAVTLTCMPKADGTHPNTRGACAQLRLAGGDFEKVTKIKEGTACTREWNPSVVTAEGVWEGRRVSFERTFANPCELKAGKGTVFEF

SEQ ID NO: 43552 - protein, 618 aa, Streptomyces clavuligerus
MRVTAPSRSPRALTVATALAVSAGLATGLLTAPPAAAASVATWDKVAQCESGGNWSINTGNGYYGGLQFSQPTWAGFGGLDYAPRADLATKREQILTAEKVLAVQGQGAWPHCGPAANLGADNADPYPDPVPPVSKVTGLASGTVATGTITLGAQVTNPVGKPTKATFYVDGAAVGTDTGAGPHYSISLDTTTLSDGAHTVTVRAVNDSGQTGPMSDAVSFLTANRANTSRTTGDFNGDNRDDVAVLYDNGRNADGTHRTALWTFTSTASGFGPPVKKWDSVSAPVNSWSWDRSKVATGDFNGDGKDDIGVLYDEGTSQMGTPAAALWTFLSTGSDFAEPSKKWYSTTSADSWTWDRSKVTTGDYNGDGRDDVGVLYNNGQASDGTNKTALWTFTSNGTAFAQPVRKWDNVSTNSGSWNWDRSKPVSGDFNGDGNADVGILYNNGQNADNVNVTALWTLTSTSTGTDFGNPVKKWDNVSTGTGSWNWDRSKVVAADFSGDGKTDVGVLYDNGQTADGRNKSALWTFTSTGTDFTNPSRKWDSGDGSWNADASKLTAGDFDGDGKADIGVLYNYGRQDDGSNRTGLWKFAGTGTGFNAPVRSWDSAGALSWNWYASDLA

SEQ ID NO: 43553 - protein, 201 aa, Streptomyces clavuligerus
MRTVGIGAGVRRLGRAVVMAAAVGGLVLGSAGASNAAGVMTGAKFTQIQFGMTRQQVLDIAGAENCETGGSFGDSIHCRGHAAGDYYAYATFGFTSAAADAKVDSKSQEKLLAPSAPTLTLAKFNQVTVGMTRAQVLATVGQGSCTTWSEYYPAYPSTAGVTLSLSCFDVDGYSSTGFYRGSAHLWFTDGVLQGKRQWDLV

SEQ ID NO: 43554 - protein, 182 aa, Streptomyces clavuligerus
  strain ATCC 27064 / DSM 738 / JCM 4710 / NBRC 13307 / NCIMB 12785 / NRRL 3585 / VKM Ac-602
MAVALTTAPAANAFSAPHPTGAQSTAAAVVTLRYDDSRATGWEAAVTAGVASWNTNVDNVKLVKASPGTRADIQFVATSGWPQATLGPVRPGGRGRIELGSQAVALGHDKTRIAAHEIGHNLGLWDTKPGPCSQLMSGSSAGATCKNAIPDAAEQAQVEAAYAARSTSVLPAEGGVLVVDDQ

SEQ ID NO: 43555 - protein, 385 aa, Streptomyces clavuligerus
  strain ATCC 27064 / DSM 738 / JCM 4710 / NBRC 13307 / NCIMB 12785 / NRRL 3585 / VKM Ac-602
MKRIIPLGSSLTALLLTLGLGATHTGTANAAPPPEPASASAPAASAGLLDALQRDLGLTPARAEERLRAEKAATAVEKTARRTAGGSYGGSWFDPASERIVVALTDPAKEDRVRALGADTRVVRHSAAALDRAKARLDTLTAPEGVAGWHVDPRRNSVVVTVVRAERNTPAVRAFVAKARTNGPVTVAEAATAPRTYAAGTVGGDPYYTGNVRCSIGFSVHGGFVTAGHCGPAGAAVRGWDGSAMGTFQGSSFPGNDYAYVSIHSGWWTVPVVLGWGAIPDRLVRGSAEAPVGASICRSGSTTKWHCGTVLGKNETVNYSQGAVHQMTKTSVCAQGGDSGGSFISGDQAQGVTSGGWGNCSTGGQTWFQPVNEILGRYGLTLHTA

SEQ ID NO: 43556 - protein, 139 aa, Streptomyces clavuligerus
  strain ATCC 27064 / DSM 738 / JCM 4710 / NBRC 13307 / NCIMB 12785 / NRRL 3585 / VKM Ac-602
MANRRRPARMSGRAGHGTGDGTPWRRARSAFGPHEKRQHMRMKPVASVAVRATLALAVLLVPLTMTAPAAHAKPNPICGGDYYGPFPGDRTKFFQCDDFGAFFVMDCAPGTEFDDSLNVCVYATPRPGGTVPAAAPQTG

SEQ ID NO: 43557 - protein, 427 aa, Streptomyces clavuligerus
  strain ATCC 27064 / DSM 738 / JCM 4710 / NBRC 13307 / NCIMB 12785 / NRRL 3585 / VKM Ac-602
MTGGRADSFPARRSSLPSLFPPPVPWFPAPGAPESPETFMPRHLSLTLPRARKAAGVLAAAALAASALAGGSASAASLATWDKLAECESGGNWSINTGNGYYGGIQFSLSTWQSMGGTQYAAYPHQATREEQITVGEKLLDAAGEGQWPHCGPRVGLGSDPADPFPTTPPMAAGMSPIVGVGDINRTGVADFVARGSDGRLYSYMGKGDGTFTGRTDLGGGWNQYDMVIGVGDINKTGVPDLLARGTDGRLYSYMGKGDGTFTGRTDLGGGWNKYNLIVGAGDINSTGVADLIARDANGDLWAHMGVGDGTFTGPTKIGHGWNQYDTIVGVGDINKTGVPDLLARNKATGHLYSYMGIGDGTLSGRTDLGAGWDQYTAITGPGDINSTGVADLIARDGSGDLYTYMGIGDGKFTGRTKAGHGYNIYS

SEQ ID NO: 43558 - protein, 332 aa, Streptomyces clavuligerus
  strain ATCC 27064 / DSM 738 / JCM 4710 / NBRC 13307 / NCIMB 12785 / NRRL 3585 / VKM Ac-602
MSTDRETISPPPESTALSEVPHQPGDSDWQGGGPDSLAEVLPLDSDDNPGSDPPGESHEDGPDGLAAAVPLEERDGESEGEGVAGEGEGREEVDDSGLPLRPEEEQDRLPLTEQRKIALSGISRGTVAFGSDQEAVEYAQDHWNPYVESLPVRQKEALREYTSEHVSSDSPPTADGRATYVEINGTLRGDASQSNPRVQENIRELDAVVNVRPTAEPMIVTRGTGLGHLNMDMDELVGEVIEERGYMSTSVGSSPPESFSGREAITHLRVPEGTPAVWVEKVGEFGSDERELLLARGLKYQVESVVMDQGSQGPRYFIYAEIVNPVVKGEGE

SEQ ID NO: 43559 - protein, 305 aa, Streptomyces clavuligerus
  strain ATCC 27064 / DSM 738 / JCM 4710 / NBRC 13307 / NCIMB 12785 / NRRL 3585 / VKM Ac-602
MLKKRLTSALTGILAAAGLAVAGLIPAATPAAADECTNAPAWRAGTAYVPGNVVRYTDGRYYIAEHANPGYDPVISHWFWNPHTCSGGGTPNPNPNPNPSGFVVTEAQFNQMFPGRNSFYTYKGLTDALSAFPAFTKTGSDTVRKQEAAAFLANVSHETGGLVHIVEQNTANYSHYCDRTRPYGCPAGQSAYYGRGPIQLSWNFNYKAAGDHLGIDLLGNPSRVQTDPAVAWKTGLWYWNTQNGPGTMTGHAAMVNGAGFGQSIRSINGSLECNGGNPAQVQSRVTNYTRFAQLLGVPTGANLYC

SEQ ID NO: 43560 - protein, 339 aa, Streptomyces clavuligerus
  strain ATCC 27064 / DSM 738 / JCM 4710 / NBRC 13307 / NCIMB 12785 / NRRL 3585 / VKM Ac-602
MLTRFTAHALIDPSPRGAPSGSRSHRMSGRAPLMSHSTPQQPYDPYGSGTQQTHGAQQPYGQQPAGPSFGQPPAPPRRMRNGLGTAALVLGLIGAISGLIPLLFWLGGTLGLIALILGLSGRARAKRGEADNRKVALAGALLGLVAMVAGVAGAVITFKAVDDAVDDIDKITTGQSASKEPGADSGPGGKDGADGADGKDKAKGTEKKGDSALTAGDSASYPDGLKVTTAKPQDFTPDEYAAGHAEGNKAYRITITVENTGTKKFDTALLMVEARAGAEGVTAEQIFDGSVGNGFSGTLAPGKKATATFGFSAPGDARDLTLEVTPGFDHDASQWELKL

SEQ ID NO: 43561 - protein, 438 aa, Streptomyces clavuligerus
  strain ATCC 27064 / DSM 738 / JCM 4710 / NBRC 13307 / NCIMB 12785 / NRRL 3585 / VKM Ac-602
MPHPPPRDRHEPDELSEATGAGAADELILGTFRPLREPDPPPRRRQPAHRAPSGRRRAPSTTRAPDAGLRRLVPQALVIAVLAGGTAAFVAGDKAVRLTVDGRTRTLHTFADDVGELLADAGVGTGAHDRVSPATTAELTSGDAVEVRYGRPLSLTLDGRRRTLWTTARTVGDALRLLAVPTAGARLSAPGSRPIPRSGLALDVRTERTVTFRADGRTHSVRTHALTVGQALSEAGILLRDEDTTSVPLDAFPRDGQNVSVLRISGAREVREESIPYEVVRVADPGLAAGTETVAQQGVPGVRRVTYELRTVDGVRREPRRIADVVVRPPVTHRVHVGTRNAPVRARTAGTGSGGSGGSDGLDWQALAHCESGGRAGAVDSSGTHGGLYQFDQGTWHSTGGSGRPQDASAAEQTYRAKRLYARRGAAPWPHCGRRLFR

SEQ ID NO: 43562 - protein, 217 aa, Streptomyces clavuligerus
  strain ATCC 27064 / DSM 738 / JCM 4710 / NBRC 13307 / NCIMB 12785 / NRRL 3585 / VKM Ac-602
MRLSTTVLSAALGAALAASLGAVPASAATAPEPPTSAAPSYAAYEGSAEDRRATAAFFQAVVKSVAEKRAANPGERVVTVTYNATSAPTFRTQIARSTQIWNSSVTNVRLQEGPNASFRYFEGDDPRGSHANTDGHGRGYIFLDYQQNQLNDSTRITSHETGHVLGLPDNYRGPCSELMSGGGPGPWCTNAVPNAAERARVNALWVNGFTKALRQAR

SEQ ID NO: 43563 - protein, 280 aa, Streptomyces clavuligerus
  strain ATCC 27064 / DSM 738 / JCM 4710 / NBRC 13307 / NCIMB 12785 / NRRL 3585 / VKM Ac-602
MSRLTLKVALLATPVLLISAVTVSCSQEDDGYRAAPAAPAGRASGPGLDNPVKKDIAMRLVSSAENSSLDWEAQYSYIEDIGDGRGYTAGVAGFCSGTGDMLDLVELYTERKPGNALARYLPALRKVDGSDSHRGLDPNYPRDWRKAAGDEEFREAQNDERDRVYFNPAVQRGKSDGLGVLGQFIYFDALVMHGDGDDSASFSSMRRKALAKAKSPAQGGSEKTYLNAFLDSRVWAMKQEAAHEDTSRVDTAQRVFVRQGNFALNTPLSWKVYGDSYHLD

SEQ ID NO: 43564 - protein, 251 aa, Streptomyces clavuligerus
  strain ATCC 27064 / DSM 738 / JCM 4710 / NBRC 13307 / NCIMB 12785 / NRRL 3585 / VKM Ac-602
MADVSFPPAGRRPPGRPGPITRVLPATGTGGRPGVSLGAEGARGAGRMMRSALMTGICRIRRRGGVLFAAAAIVLAAAGPAPATSAGGRSAGYPCGGWTRTADGSTPANFETCAGGTTVVSPCPAGLLYRVDADLCDYPANVRQAPTGLAAGTARLRLLPLPPGVSGLTATLTLTGGRPVPDATIAFTTVTGQPLCSAVTDGTGHASCDTDGLVQSIGELLAGYQAVFTPAEANGITNLAPAQAAGTVTLL

SEQ ID NO: 43565 - protein, 375 aa, Streptomyces clavuligerus
  strain ATCC 27064 / DSM 738 / JCM 4710 / NBRC 13307 / NCIMB 12785 / NRRL 3585 / VKM Ac-602
MRSSVSATLGRLRIAGITVALAALAPFAAATAEAASVETWDKVAQCESGGNWSINTGNGYYGGLQFSLQTWRAYGGADYAAYPHQATKKQQILTAEKVLAGQGEGAWPTCGPRHGLGSDPAEPYPPTIPARDFTGDGRDDLLGISDAGELRLFETGADLSFATRVVGPGWAAKDLASAGDVNGDGRGDVVAVDRVTGDLHLWTGRGNGSLNAAVQVGRGWTNIEQLAVGDFTGDGKADVVAITRDTANLLLYPSSGSGFSGPVVLGTSGWGSVKNLAVGDFTGDGRADVVATNETSGQLSLYPSNGSGLNGSAVIGSSFHLKDKLTMADLNKDGTSDIVAVDRATGDLTIYASNGSAITDTRKIGDGWSTMTNLL

SEQ ID NO: 43566 - protein, 297 aa, Streptomyces clavuligerus
  strain ATCC 27064 / DSM 738 / JCM 4710 / NBRC 13307 / NCIMB 12785 / NRRL 3585 / VKM Ac-602
MKIHKVSLSQRARMVAVVAGLVTVSALIAPTAVAAESAPKPGAAQLAQVSDAVLDADISGTAWYTDAKSGKVVVTADSTVSAAEIDRIKKQAGAESGALKINRTPGTFSKMIAGGEAIYTAGARCTLGFNVVRAGVFYALTAGHCTNIGPSWTTAVGPLGNRFASVFPGSDHGVIQHAIPANADGRVYLHNGTYRDMVNASTPLIGQFVERSGSTTGYHTGRVTGLNATVNYGGGQLVYGLIQTNVCGQPGDSGGPLFSGNTAHGLLSGGSGNCTVGGTTFYEPVLRPLTQYGLTIF

SEQ ID NO: 43567 - protein, 389 aa, Streptomyces clavuligerus
  strain ATCC 27064 / DSM 738 / JCM 4710 / NBRC 13307 / NCIMB 12785 / NRRL 3585 / VKM Ac-602
MTDVRLPLRSPRLSSLAKGNRMLSGNGRHRRPRQAPALVVAAGVTGSAIALPLLGAGSATAADSAVWDRVAECESGGAWSADTGNGYYGGLQMSQQTWEAYGGLEYASGPDLASRSQQITVAEKVLAAEGAKAWASCAGMAGLAVPGADAAPKKATGATEDAAPSGARSGGADADSGPSGKARAGDAAPSAAAGKDKGATDRNAEQGSPAPARTQGVGNGTDSAPAAGKGTPAPTGGGKHRGAPAEESAARAEKTAGTADRDGTAGQDAASAPAAGSTASEAATADTGAAPQDRATGTADRPSRAGEARTELTADTAATAADRATAAGAADTSPSSYTVQPGDSLSVIAAEKDVDGGWNSLYERNKDTVGADPDLIHPGQSLDLENAQQ

SEQ ID NO: 43568 - protein, 253 aa, Streptomyces clavuligerus
  strain ATCC 27064 / DSM 738 / JCM 4710 / NBRC 13307 / NCIMB 12785 / NRRL 3585 / VKM Ac-602
MLFSGKGKHRRPTALNRATRIVAFAGVTGAAVAAPLAGASTATAATAAEWDKVAQCESGGNWSINTGNGYYGGLQFSTSTWAAYGGTAYAPTADKATKAQQIAIAEKTLAGQGKGAWPKCGVGLSNTPYGSAAPAPAQPKPQQQAPKQVQQAPKQQTAPAPQQRAEAPTTRSVERTAPAPVQQAPQQAAPQTQAPAKGFLKGDGEYEVKAGDTLSSIAEDHKVKGGWQKLFQLNEDIVDNADVIYVGQQLHLR

SEQ ID NO: 43569 - protein, 426 aa, Streptomyces clavuligerus
  strain ATCC 27064 / DSM 738 / JCM 4710 / NBRC 13307 / NCIMB 12785 / NRRL 3585 / VKM Ac-602
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATENKGSLGANAILGVSLAVAHAASEASDLPLFRYLGGPNAHLLPVPMMNILNGGSHADSNVDIQEFMIAPIGAESFSEALRWGTEVYHTLKKVLKQKGLATGLGDEGGFAPNLDSNRAALDLILEAIKEAGYVPGKDIALALDVAASEFYKDGVYEFEGKPLSAAELTEYYEELVAAYPLVSIEDPLFEDDWAGWKVLTDKLGTKVQIVGDDLFVTNPERLARGIEEGSANALLVKVNQIGSLTETLDAVELAQRNGFKCMMSHRSGETEDVTIADLAVATNCGQIKTGAPARSERVAKYNQLLRIEEILDDAAVYAGRSAFPRFKG

SEQ ID NO: 43570 - protein, 781 aa, Streptomyces clavuligerus
  strain ATCC 27064 / DSM 738 / JCM 4710 / NBRC 13307 / NCIMB 12785 / NRRL 3585 / VKM Ac-602
MLSPTRTRASLLAAGTAIAALLTGSLSAGAAQAAPAPEAGTASAHESCRPEGLYSTPGVDVPYCSVYDTQGREKMGADHQRRVIGYFTNWRTGKDGRPAFLANNIPWDKITHINYAFAAIDGANKITVGTDGPNNPNTGMTWPGVAGAEMDPALPYKGHFNLLNKFKKQHPDVKTLISVGGWTDTGGYTDDNGNRVNSGGFYSTTTNADGSVNQAGINTFADSAVAFIKKYGFNGVDIDYEYPTTMKDAGHPADWALANGRRAGLVKSYAALMKTLREKLDRAGAADGKHYMLTVAAPSSGYLLRGMETFQVQKYLDYLNIMSYDLHGTWNEHVGPQAALFDDGKDSELASAGVYSTSQYGGIGYLNTDWAYHYFRGSMPAGRINIGLPSYSRGWKNVQGGTDGLWGKSSASTCPAGSGLTKCGDGAIGIDNIWHETDSNGVEAPAGFNPMWHAKNLEKGIVPDYLPKFGLPANTRLTGTYARKYDSTLVAPWLWNAQKKVFLTTEDEQSIAAKADYVASKGIGGTMMWEFAGDYDWNATKGQYEQGSTLTGVLYNKFKTATPYGNKKAAAAPAMPTDVINVDVDFGQFALGDQNYPISPKLKITNNTKVALPGGTEFQFDYATSAPNNAKDQSGFGTTIVRSDHTGPNVGGLKGDFHRVSLKLPAWQTLAPGASVELDFVYYSPVSTPSNWTVTFGGKTYGIASDLARGVKLVEPTDGSGGPGPGPGGPCTAPAWTATGEYGTNATVSHKGRNYKAKWWTKGDEPGTTGQWGVWTDLGAC

SEQ ID NO: 43571 - protein, 618 aa, Streptomyces clavuligerus; identical to SEQ ID NO: 43552
  strain ATCC 27064 / DSM 738 / JCM 4710 / NBRC 13307 / NCIMB 12785 / NRRL 3585 / VKM Ac-602

SEQ ID NO: 43572 - protein, 1428 aa, Streptomyces clavuligerus
  strain ATCC 27064 / DSM 738 / JCM 4710 / NBRC 13307 / NCIMB 12785 / NRRL 3585 / VKM Ac-602
MIDRATGRRRRHRLRGTLLAGVLVAEVGIVVTGGAATPAAATAPTATATATADGDRAPRRAASAAGIAASVPVSTPLYIQNVNNGGHIGVMSGNIDPGLPDVAVQAPQGDDKHQSWTLEPDGSGHRLRNTELPTQCLVHYGEAPAILGDCTGLGTVWDVQSLGGDRFRIKQPGTDRHLSTAGEISKSSKETPLAYASTDGNKEWIFTAVSWPRLPMPPEDRRTLEHMTFLTAHNSMINTEDGYDTLAPNQPHSMRRQLADGVRALMPDVNAGVVNGTIPLCHGGKCGGQIVPSNNFGSMLTTVKEFLDTNRKEIVTLFIEDVSMTDLTNDDYLRHGFDQAPGARDLLFVPDDTVVPAELKQGWNVQDNGWPLLKDMIAKNKRLLIFSGQEKRQEIGFMADQRWRVENHWQMGLGLGDADWSCFSRWGGRPLSTGTSGQTGRFKPLFVMNHFRQVPMAPTYTNDNRKLRQRAESVCTTAARRKPNFVAVDQYRDGDLFPQIQAMNEYWYRGGEGAGQEPGPGPGPQPGPGSAGDPVDTGTDHRGPKPAVSGPHSACRPDGMAATPGVTARYCDVYGTDGREWLGGNGQDRRVVGYFHSGRHGKDGKPRYLVKNIPWTKVTHINYAFARIEGDRISVGDEQSPDNPATGMTWPGVRGAEMDESLPYRGHFNQLAVYKRKHPQVKPLIAVGGWSDSKGFYAMTTNADGTVNQAGINTFADSVTAFLGRYGAAFDGVDIDHEYPTALPDSGNPDDWALANPRRKGLQAGYNALMKTLREKLDRAGAERGRYYLLTSAASASGHLVRGYDGGQALAHQDFVNVMAYDLHGSWNQFVGPQAPLYDDGKDGELAAAGVYDSAKNPEYDRTGYFNVDWAYHYYRGALQPGRINLGLPLYTRGWRDVRGGTNGLWGTAPLTDQGQCQPGTGTRTPCGNGAVGIDNVWHDTSRGREVAAGVNPLWHARNLQDGITPGYLTSYGLDPARPENRLTGTYQRHYSGELEAAWLWNPEKKVFLTTEDERSVNAKVQYVKDRGIGGVMMWELSGDYTRGADGQYVMGYDTTTRIADGLRGAGAYRGERAGATPLPGQVLDVSAEFTGYPTAEADLWPQQPKLRITNNSTRPLPSGTELSFDIPTSAPPLLKDDAWQDMKDAVQPGRSGPNTGGLKADFHRVTIKLGHCESIAPGKSREIGVKYFLPLTGPANFTLKTGGTTYGLTQDRRRGTTTVEPPATGGGPACQAEAWDAARTYNPAWAPFALWRTQGGWKIQDPGSSLVVDHPGTWATTHLIGSQDGNANQVWNIVPDGSTGRFRIITASGGRQQCLGADGRLAEASVRSCDGGAAQSWSFTDERGAPVAGIPADGRPHGLLAASGHVLEPRNSGGTVRTKLVAGDPEGATRTVVSYGGFYWKAKFWTKGNRPDAADPKNAWSRLGPVA

SEQ ID NO: 43573 - protein, 196 aa, Streptomyces clavuligerus
  strain ATCC 27064 / DSM 738 / JCM 4710 / NBRC 13307 / NCIMB 12785 / NRRL 3585 / VKM Ac-602
MLPCIRLASAAATVVAVALTTAPAANAFSAPHPTGAQSTAAAVVTLRYDDSRATGWEAAVTAGVASWNTNVDNVKLVKASPGTRADIQFVATSGWPQATLGPVRPGGRGRIELGSQAVALGHDKTRIAAHEIGHNLGLWDTKPGPCSQLMSGSSAGATCKNAIPDAAEQAQVEAAYAARSTSVLPAEGGVLVVDDQ

SEQ ID NO: 43574 - protein, 415 aa, Streptomyces clavuligerus
  strain ATCC 27064 / DSM 738 / JCM 4710 / NBRC 13307 / NCIMB 12785 / NRRL 3585 / VKM Ac-602
MDLSSQCRYRNGPRPVRTLSGVRLPPPGGSVKRIIPLGSSLTALLLTLGLGATHTGTANAAPPPEPASASAPAASAGLLDALQRDLGLTPARAEERLRAEKAATAVEKTARRTAGGSYGGSWFDPASERIVVALTDPAKEDRVRALGADTRVVRHSAAALDRAKARLDTLTAPEGVAGWHVDPRRNSVVVTVVRAERDTPAVRAFVAKARTNGPVTVAEAATAPRTYAAGTVGGDPYYTGNVRCSIGFSVHGGFVTAGHCGPAGAAVRGWDGSAMGTFQGSSFPGNDYAYVSIHSGWWTVPVVLGWGAIPDRLVRGSAEAPVGASICRSGSTTKWHCGTVLGKNETVNYSQGAVHQMTKTSVCAQGGDSGGSFISGDQAQGVTSGGWGNCSTGGQTWFQPVNEILGRYGLTLHTA

SEQ ID NO: 43575 - protein, 388 aa, Streptomyces clavuligerus
  strain ATCC 27064 / DSM 738 / JCM 4710 / NBRC 13307 / NCIMB 12785 / NRRL 3585 / VKM Ac-602
MPRHLSLTLPRARKAAGVLAAAALAASALAGGSASAASLATWDKLAECESGGNWSINTGNGYYGGIQFSLSTWQSMGGTQYAAYPHQATREEQITVGEKLLDAAGEGQWPHCGPRVGLGSDPADPFPTTPPMAAGMSPIVGVGDINRTGVADFVARGSDGRLYSYMGKGDGTFTGRTDLGGGWNQYDMVIGVGDINKTGVPDLLARGTDGRLYSYMGKGDGTFTGRTDLGGGWNKYNLIVGAGDINSTGVADLIARDANGDLWAHMGVGDGTFTGPTKIGHGWNQYDTIVGVGDINKTGVPDLLARNKATGHLYSYMGIGDGTLSGRTDLGAGWDQYTAITGPGDINSTGVADLIARDGSGDLYTYMGIGDGKFTGRTKAGHGYNIYS

SEQ ID NO: 43576 - protein, 316 aa, Streptomyces clavuligerus
  strain ATCC 27064 / DSM 738 / JCM 4710 / NBRC 13307 / NCIMB 12785 / NRRL 3585 / VKM Ac-602
MPPIPDILSVRPTDELFLEVRVSIPHRRRPRRPQTPLSRLTLKVALLATPVLLISAVTVSCSQEDDGYRAAPAAPAGRASGPGLDNPVKKDIAMRLVSSAENSSLDWEAQYSYIEDIGDGRGYTAGVAGFCSGTGDMLDLVELYTERKPGNALARYLPALRKVDGSDSHRGLDPNYPRDWRKAAGDEEFREAQNDERDRVYFNPAVQRGKSDGLGVLGQFIYFDALVMHGDGDDSASFSSMRRKALAKAKSPAQGGSEKTYLNAFLDSRVWAMKQEAAHEDTSRVDTAQRVFVRQGNFALNTPLSWKVYGDSYHLD

SEQ ID NO: 43577 - protein, 491 aa, Streptomyces clavuligerus
  strain ATCC 27064 / DSM 738 / JCM 4710 / NBRC 13307 / NCIMB 12785 / NRRL 3585 / VKM Ac-602
MCRAPDLGSGGRGGGARRAERPLAGPDPPAEYSQRRLSGHAAAGNGTVSTTTAPHGSRTSHRAPESLREECHVRTERTTPLRTPVPSAPTALVTGGGRDTAPPRHTGALCPGWHSSTTGHVSTTVRTSPTGHAPATGHASTTEHASTTGHAPATGHAPATVRASSAGYASTTGHSRTGGHIWTIPHLCRPSWPSRSRPFRPWGITARWLRPAAVLTGLVAVAVLTAPAAAAPGTRAGPYALAAASDAVHTADVAGTAWYTDPVAGRVVLTADATVTPAALARIRSAAGPYAALLRVERAPGVLTELTGGGDRVHTLGRTCSAGFNVRGGSARYILTAGHCTVATATWYADSALRTAVGPAVATHFPGADFGLIRYDNPSVPRPGKVGRVDITGVAHARVGMSVTRRGGVSGVARSTVTGVGITVNYGRGVIVSGLIRSDVCAENGDSGSPLHSGPLAVGIVSGGTGDCATGGVTYFQPVAPALARLGVTVY

SEQ ID NO: 43578 - protein, 242 aa, Streptomyces clavuligerus
  strain ATCC 27064 / DSM 738 / JCM 4710 / NBRC 13307 / NCIMB 12785 / NRRL 3585 / VKM Ac-602
MVTSSRSTSGSPAPVPGARAGARGSRGAGRPGTLALAGAALIAPLVVLGAGTGTARAADAGVWDRIARCESGGNWHINTGNGYYGGLQFAPSTWRAHGGTAYAPTADRASRSQQIAVAVRVQRAQGWGAWPTCSARAGAHGSAPSVAAAPERRPATAPRSPAVRQAPAADRNRTRAVPQRATGHTSRSGERARGTAYTVRAGDTLSSIAQAHGTDWRTLHTANRQVVGADPDLIVPGQRLTL

SEQ ID NO: 43579 - protein, 359 aa, Streptomyces clavuligerus
  strain ATCC 27064 / DSM 738 / JCM 4710 / NBRC 13307 / NCIMB 12785 / NRRL 3585 / VKM Ac-602
MRRSLRARICLTVLLTLPALGLGTGTAGAAPDPSPVPVPEQGVAASPDQYRLSDRLERTLGDDTAGAYLDPRSGELVVTVTSAEAAAEVEAQGARAEIVRRGPAELRAAVTALESQAKITGTSWGLDPSTNQIAVQADSSVPAASLARLARVAAGLRGAVRIERVPGVFTREVAGGDAVHGGGYRCSAAFNVSRGGAYYFLTAGHCTEAAATWSDRSGGAAIGATEGSSFPGDDFGLVRYTTTGQPPGTVNRWDGSFEDVASAADAVVGQSLQKSGSTTRLTSGQVTAVNVTVNYSDGPVYGMVRTTICSAGGDSGGAHFSGTTALGIHSGSAGCTGTRGTAIHQPVSEPLAVYGVTVY

SEQ ID NO: 43580 - protein, 602 aa, Streptomyces clavuligerus
  strain ATCC 27064 / DSM 738 / JCM 4710 / NBRC 13307 / NCIMB 12785 / NRRL 3585 / VKM Ac-602
MTRAWLDRYLLLHHCINSCRSTPVSPTRRLFVSSRRTLIAALTTAALAAGGLASVAATSGTANASAPQTTAAAAPTTGGVKIAYYDQWSVYGNAFYPKHLDTRGIAGKLDIINYSFGNIHPTELTCFQANKAAGDDNNPNAGDGAGDSYADYQRTFNAETSVDGVADRWDQPIAGLFNQFRKLKVKYPKLKINISLGGWTYSKYFHDAAKTDASRKKFVSSCINQYLKGDLPVADGFGGPGSAAGVFDGIDIDWEYPGSNGGHLGNHYGPEDKANFTLLLAEFRKQLDVYGAANGGKKYLLTAAMPAGQDKIKHIETDKVGAYLDYANIMTYDMHGSWRTTGPTYHQSPLYSPASDPTDPIAPGTEKYSIDNAVKAWIDGSPAYNIAGGFPAKKITLGYEMYYRGWKNVPAGAKNGLGQSANGGSAPRPLSQAAGIANYKELGGIVDNPATTFWDDEAKAAYFYKNGEFFTGLDKRAIQARASYAHQRGLGGAMMYSLIGLDDRTTLLNDIVAAVGPSPVEPGPNPTPTPTPTPTPTPTPTPTPTPTPSPGCTAAAWAASGTYNTNALVSHKGRVWKAGWWTQGEEPGTTGQWGVWRDQGPC

SEQ ID NO: 43581 - protein, 804 aa, Streptomyces clavuligerus
  strain ATCC 27064 / DSM 738 / JCM 4710 / NBRC 13307 / NCIMB 12785 / NRRL 3585 / VKM Ac-602
MSENDHPPRPCRATAPPTRRIRPLLSPTRTRASLLAAGTAIAALLTGSLSAGAAQAAPAPEAGTASAHESCRPEGLYSTPGVDVPYCSVYDTQGREKMGADHQRRVIGYFTNWRTGKDGRPAFLANNIPWDKITHINYAFAAIDGANKITVGTDGPNNPNTGMTWPGVAGAEMDPALPYKGHFNLLNKFKKQHPDVKTLISVGGWTDTGGYTDDNGNRVNSGGFYSTTTNADGSVNQAGINTFADSAVAFIKKYGFNGVDIDYEYPTTMKDAGHPADWALANGRRAGLVKSYAALMKTLREKLDRAGAADGKHYMLTVAAPSSGYLLRGMETFQVQKYLDYLNIMSYDLHGTWNEHVGPQAALFDDGKDSELASAGVYSTSQYGGIGYLNTDWAYHYFRGSMPAGRINIGLPSYSRGWKNVQGGTDGLWGKSSASTCPAGSGLTKCGDGAIGIDNIWHETDSNGVEAPAGFNPMWHAKNLEKGIVPDYLPKFGLPANTRLTGTYARKYDSTLVAPWLWNAQKKVFLTTEDEQSIAAKADYVASKGIGGTMMWEFAGDYDWNATKGQYEQGSTLTGVLYNKFKTATPYGNKKAAAAPAMPTDVINVDVDFGQFALGDQNYPISPKLKITNNTKVALPGGTEFQFDYATSAPNNAKDQSGFGTTIVRSDHTGPNVGGLKGDFHRVSLKLPAWQTLAPGASVELDFVYYSPVSTPSNWTVTFGGKTYGIASDLARGVKLVEPTDGSGGPGPGPGGPCTAPAWTATGEYGTNATVSHKGRNYKAKWWTKGDEPGTTGQWGVWTDLGAC

SEQ ID NO: 43582 - protein, 454 aa, Streptomyces clavuligerus
  strain ATCC 27064 / DSM 738 / JCM 4710 / NBRC 13307 / NCIMB 12785 / NRRL 3585 / VKM Ac-602
MDPARRLGSCRKANGALHPCVTSQKEMLVPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATENKGSLGANAILGVSLAVAHAASEASDLPLFRYLGGPNAHLLPVPMMNILNGGSHADSNVDIQEFMIAPIGAESFSEALRWGTEVYHTLKKVLKQKGLATGLGDEGGFAPNLDSNRAALDLILEAIKEAGYVPGKDIALALDVAASEFYKDGVYEFEGKPLSAAELTEYYEELVAAYPLVSIEDPLFEDDWAGWKVLTDKLGTKVQIVGDDLFVTNPERLARGIEEGSANALLVKVNQIGSLTETLDAVELAQRNGFKCMMSHRSGETEDVTIADLAVATNCGQIKTGAPARSERVAKYNQLLRIEEILDDAAVYAGRSAFPRFKG

SEQ ID NO: 43583 - protein, 368 aa, Streptomyces clavuligerus
  strain ATCC 27064 / DSM 738 / JCM 4710 / NBRC 13307 / NCIMB 12785 / NRRL 3585 / VKM Ac-602
MLSGNGRHRRPRQAPALVVAAGVTGSAIALPLLGAGSATAADSAVWDRVAECESGGAWSADTGNGYYGGLQMSQQTWEAYGGLEYASGPDLASRSQQITVAEKVLAAEGAKAWASCAGMAGLAVPGADAAPKKATGATEDAAPSGARSGGADADSGPSGKARAGDAAPSAAAGKDKGATDRNAEQGSPAPARTQGVGNGTDSAPAAGKGTPAPTGGGKHRGAPAEESAARAEKTAGTADRDGTAGQDAASAPAAGSTASEAATADTGAAPQDRATGTADRPSRAGEARTELTADTAATAADRATAAGAADTSPSSYTVQPGDSLSVIAAEKDVDGGWNSLYERNKDTVGADPDLIHPGQSLDLENAQQ

SEQ ID NO: 43584 - protein, 313 aa, Streptomyces clavuligerus
  strain ATCC 27064 / DSM 738 / JCM 4710 / NBRC 13307 / NCIMB 12785 / NRRL 3585 / VKM Ac-602
MSGRAPLMSHSTPQQPYDPYGSGTQQTHGAQQPYGQQPAGPSFGQPPAPPRRMRNGLGTAALVLGLIGAISGLIPLLFWLGGTLGLIALILGLSGRARAKRGEADNRKVALAGALLGLVAMVAGVAGAVITFKAVDDAVDDIDKITTGQSASKEPGADSGPGGKDGADGADGKDKAKGTEKKGDSALTAGDSASYPDGLKVTTAKPQDFTPDEYAAGHAEGNKAYRITITVENTGTKKFDTALLMVEARAGAEGVTAEQIFDGSVGNGFSGTLAPGKKATATFGFSAPGDARDLTLEVTPGFDHDASQWELKL

SEQ ID NO: 43585 - protein, 589 aa, Streptomyces clavuligerus
  strain ATCC 27064 / DSM 738 / JCM 4710 / NBRC 13307 / NCIMB 12785 / NRRL 3585 / VKM Ac-602
MVVSDLSQVGSGGQGGYGAGEHLLDRDHPGRSDGQGRPLRGHPFVRAFPVGDPRPGGVPVPPQQTAPPAYTPGHGYGHPQAYGYGRPQGYGHGHPQAYGWGYGPTVPQPAYTPQEPYTPQPAYTPQPSYAPQTPYAPQSPYHPPQAPPPAPVPHPPPRDRHEPDELSEATGAGAADELILGTFRPLREPDPPPRRRQPAHRAPSGRRRAPSTTRAPDAGLRRLVPQALVIAVLAGGTAAFVAGDKAVRLTVDGRTRTLHTFADDVGELLADAGVGTGAHDRVSPATTAELTSGDAVEVRYGRPLSLTLDGRRRTLWTTARTVGDALRLLAVPTAGARLSAPGSRPIPRSGLALDVRTERTVTFRADGRTHSVRTHALTVGQALSEAGILLRDEDTTSVPLDAFPRDGQNVSVLRISGAREVREESIPYEVVRVADPGLAAGTETVAQQGVPGVRRVTYELRTVDGVRREPRRIADVVVRPPVTHRVHVGTRNAPVRARTAGTGSGGSGGSDGLDWQALAHCESGGRAGAVDSSGTHGGLYQFDQGTWHSTGGSGRPQDASAAEQTYRAKRLYARRGAAPWPHCGRRLFR

SEQ ID NO: 43586 - protein, 371 aa, Streptomyces clavuligerus
  strain ATCC 27064 / DSM 738 / JCM 4710 / NBRC 13307 / NCIMB 12785 / NRRL 3585 / VKM Ac-602
MSATLGRLRIAGITVALAALAPFAAATAEAASVETWDKVAQCESGGNWSINTGNGYYGGLQFSLQTWRAYGGADYAAYPHQATKKQQILTAEKVLAGQGEGAWPTCGPRHGLGSDPAEPYPPTIPARDFTGDGRDDLLGISDAGELRLFETGADLSFATRVVGPGWAAKDLASAGDVNGDGRGDVVAVDRVTGDLHLWTGRGNGSLNAAVQVGRGWTNIEQLAVGDFTGDGKADVVAITRDTANLLLYPSSGSGFSGPVVLGTSGWGSVKNLAVGDFTGDGRADVVATNETSGQLSLYPSNGSGLNGSAVIGSSFHLKDKLTMADLNKDGTSDIVAVDRATGDLTIYASNGSAITDTRKIGDGWSTMTNLL

SEQ ID NO: 43587 - protein, 787 aa, Streptomyces clavuligerus
  strain ATCC 27064 / DSM 738 / JCM 4710 / NBRC 13307 / NCIMB 12785 / NRRL 3585 / VKM Ac-602
MPQPSAWSRRAFLAGLTATGATTAAAPPAAADTRPPGASGGSEPGDPYEGLRRRWLEIALGGGYDPAAEPYASRIARTVRLAADHLAAMAPTPTSLWPGHPYDPPAGITRSCARLWTMAQGWHHTGDPALLAGVVRGLDHLAATVYHPGTTRYGNWWEWQIGSPRLLLDTVAALGDRLTPDRREAVCAAVDHFIPDALLGSYTGTSTGANRVDLARSVALRGILGRRPAKIALARDALTPVFPHVTAGDGLYADGSFVQHTWVAYSGTYGQVLLDGLARLLALLTGSPWAVTDPRRQLVLDSVEHAFAPLIHNGLMMDVVNGRAVSRGRLAGDEGTVPRGDHFHGHAMIAAIALLAESASPAERDRWHARIRGWTYRDTTEPVLTSPQFGVAALARLHTIAAAPGPVAPEPTGHRLFAAMDRAVHRRPGWAAAVAMASERIAHYECGNGEHPRGWHTGAGMVLWWPADTQGGQYTDAFWPTVDPYRMPGTTVSTRRLPDRAGGEWGEPRPPVRWVGGATDGEYAAVGQQLAGLGSTLTARKSWICADDAIICLGSAIGCRDGVPVETVIDNRNLGAPGSPAASPALATGPGWAHLPGHGGWVVPGGQRLRTLREDRTGAWRDINSGGSPERITRRYQTLWLDHGSDPTAAAYRYLLMPGANRRAVAARAQDPGWLTVHALDAARHAVSVRSLGLLAANFWEPGRAGPLTASAPVSVLVRRRPGRRAALWLAEPPRTGAPVEIVWHRPVRRVTAHDPGIEVRSTGRALRLRLNGATACASHGCEVALD

SEQ ID NO: 43588 - protein, 818 aa, Streptomyces coelicoflavus ZG0656
MFNQSNGFDSRPIPWRHQPLRHTCRGAVPLPPSRVIDGMSMTPQRPTAPTRRAVLLAAAAAALTAVPRPASAASDAYDALRRRWLDIALGTGYDPAAEPYASRLAETGRRARDHRATMAPTPTSLWPGHPFDPPAGITFAYGRLWTMTEAYVQEGTGSTGDPALLAGILRGLDHLTATVYHPGTTRYGNWWEWQIGSPRLLMDITAALHDHLGTDRVAAACAAVDHFVPDATLGDYSGTSTGANRVDLCRSVALRGILGRAPDKIALARDALSPVFPYVTEGDGLYADGSFVQHTWVAYSGTYGQVMLDGLGRLFTLLAGSEWAVTDPARQIVLDSVEHAYAPLIHDGLVMDIVNGRAISRGYLKSDDLHVMRGDHFHGRQLVAAMAVLAGGASDAERERWYARIKGWIERDTVTPVLTAPEFPVADLARLHAIADAPGEPAPEPTGHHLFAAMDRAVHRRPAFTAGLAMASDRIAHYECGNGENPRGWHTGAGMLTWWGNGTRSDRSDQYTDWFWPTVDWYRLPGTTVSTKRLPDRAGGEWGEPKPDVRWVGGTTDGTYAAVGQHLKGLGSTLEARKSWFFLDDAVVCLGAGITCADGVPVETVVDNRNLGEGGTQALVRGRDWAHLESHGGWIVPGGGLRTLREDRTGAWSDINTTSTTERRTRRWQTLWLDHGTDPADADYVYAVLPGASRDTVARRAADRRWLRILANDARRQALAVPSLGVTAANFWQAGTAGPLTATSGASVLVRRRGRSATLCVSEPPRTGQPLEIIWDHPVSAVPRADETVEILATGRRLHLRVTPGVVCTTHECEVTLS

SEQ ID NO: 43589 - protein, 110 aa, Streptomyces coelicoflavus ZG0656
MRGSRGRRIRTAAVTLVAATALGATGQAVAAPSAPARTDWDAIAACESSGNWQANTGNGYYGGLQFARSSWIAAGGLEYAPRADLATRAEQIAVAERLARIQGMGAWGCA

SEQ ID NO: 43590 - protein, 1066 aa, Streptomyces coelicoflavus ZG0656
MLRQTAVAGTVLAMTLAGVVVPASLASASERSAPSAAEPTPVERAVAAADRAVRSGLDALVAGGPDEQYDRHQVTPWDKNLFSVAYERTYHGLPVVGGDAVVLADGKGGVRAVRSATEAAIAVPTEAAIEAEQAVRTSRKQLAEVDKVDSKRLVVRVKDDVQTLAWETVLVGTTKDHVPSKLHVFVDARTGKVVDKYDDVKAGTGHSEWNGPDPLTIDTSRSGSQYALRDTTRPGLQCSDYNGGLFTGPDDDWGTGNASSRETGCVDVMYAAQKEWDMLRDWLGRNGHNGNGGSWPTSVGLNQLNAYWDGSRVTIGHNSAGKWIAGMDVVGHEYGHGLDSYTPGGANHESGLGEATGDIMGALTEAYADQPSGYDTPDYTVGEEINLQGRGPIRNMYNPQLVNNDPNCYSSAIPRTEEHAAAGPMNHWFYLLAEGSDPGGGKPSSPTCDGSRVTGIGIQNAGKIFYGGMLLKTSGMTYKRYRSATLTAAKELDASCDLFDATKAAWNAIDIPAQSGDPTCTRQETDFSLALSPASGDVEAGSAVNATVNTSTVTGSAQQVSLTATGTPPGVSVTFSPSTVTSGSNSTMRVSTTSGTAAGTYSLTVRGTAGSKNHTAQYTLTVGGGNNPGTPPDVDVAQVQAHLAQFGSIAAQNGGNRRSTGSGYDASLAYVKGRLQAAGYTVTEQTCTSGCSAGAGNNLIAEWPKGDANSVYMFGAHLDGVAAGPGINDNGSGSAALLETALTLAEQNPTMKNRVRFAWWTDEEQGLNGSDFYARTLGSTERSRIKAYYNFDMVASVNGGYFINNLTSAASAPMREYWTSLGLAPQENVEGQGRSDDYSFQQVGIPTSGYATGASAVKSSTEAAKWGGTAGRSYDPCYHSACDTTSNINATALNRSADGIAYTIWKTAVGDAPDPQDDFSISANPSSGTVDPGSSATVTVNTATTSGDAQNVRLSASGAPTGVSVDFTPDSVTSGQSSTATVQVAAGTAGGTYTLTLTGTGTVTHTTTYTLTVSGDGGGETTWRLGATYAAGDVVTYDGVGYRCIQGHTAYPGWEPPNVPALWQRL

SEQ ID NO: 43591 - protein, 244 aa, Streptomyces coelicoflavus ZG0656
MRTKRRVAFAVGALVAPLLAVSLPASTANAHGWVTSPGSRQDQCAAGIVDCGQIKYEPQSVEGPKGLKSCSGGNSQFAELDDDSKGWRVTPVGTTHTFTWHHTARHATANWQYFIGNQKIAEFDGHSAQPAPDVSHQVNFGGFTGRQKVLAVWNVADTGNAFYSCIDVNIGGTGGGDGGGDGGGDGDPGACDAPLWNAGSVYGGGDTVSYGGHTWRAKWWVTGEEPGTTGEWGVWEDLGVCAAA

SEQ ID NO: 43592 - protein, 445 aa, Streptomyces coelicoflavus ZG0656
MAVRGRHRRYQPNRINRASLTVTAGGAGLALPLVGTGTAHAADVATWDKVAACESTHDWDINTGNGYYGGLQFTQSTWEAFGGTRYAPRADLATKDQQIAVAEKVLDAQGPGAWPACSQRAGLTRGGDTPDIRPAGGAGAEKSSGKSAGESAVRPAKKADSVKDVQPQTTPQSRAGTARMYTVVTGDTLSGIADAHEVRGGWQRLYEANRGEIGSDPDLILPGQRLSMRGQGATKAPGARTSKQDKQNEQDKQEKRQTERKQQTERKREPKQPNRQEQQKAQKAQKAPKKSSSDSGKAEAGKSKAGGSTAQRAVVAPVDAATGTPYHQAGSSWSKGYHTGVDFPVPTGTSVKSVTAGRVVSAGWGGSYGYQVVVRHGDGRYSQYAHLSAISVKAGQSVGVGQRLGRSGATGNVTGPHLHFEVRTGPGFGSDVDPLAYLRAGGVRI

SEQ ID NO: 43593 - protein, 144 aa, Streptomyces coelicoflavus ZG0656
MRNTARWAATLGLTATAVCGPLAGASLASPATAPASLYAPSALVLTVGHGESAATAAPLRAVTLTCAPTASGTHPAADAACAELRAAHGDPGALAAEDSVMCTREYAPVVVTVDGVWQGRRLSYERTFANECVKNAGSASVFTF

SEQ ID NO: 43594 - protein, 379 aa, Streptomyces coelicoflavus ZG0656
MSHKRIPKRRAAMAAGGVVALGAAAILLPNANASQDGGSSDEAAAAPRTLKSADASDLATRLAGLLGDTFAGSYYDSGAQRLVVNVVPGEDDRVVARAKQAGAEVREVDNSMGELRSGARTLKSEASIPGTSWAIDPRTNKILVTADSTVTGDRWDRLESTVQSLGSGMATVRKSAGTFKTFASGGDAIFGGGARCSLGFNVTAGDGSPAFLTAGHCGVAADQWSDAQGGQPIATVDQAVFPGEGDFALVKYDDPATEAPSEVNLGDQTLPISRAAEAAVGQEVFRMGSTTGLADGQVLGLDATVNYPEGTVTGLVQTDVCAEPGDSGGSLFTRDGLAIGLTSGGSGDCTVGGETFFQPVTTALEAVGATLGDTGAGAG

SEQ ID NO: 43595 - protein, 280 aa, Streptomyces coelicoflavus ZG0656
MRHPFPDPARPAGPSRRTVIAMACASLATVPLLTPSRAAAASARATGLDDPAKKEIAMQLVSSAENSSLDWKAQYRYIEDIGDGRGYTAGIIGFCSGTGDMLDLVELYAERSPGNVLAPYLPALRRVDGSDSHDGLDPGFPDDWRRAADGDPEFRRAQDDERDRVYFDPAVRRGKDDGLRTLGQFAYYDAMVMHGEGGGLGFGSIRERALGRARPPAQGGDEVAYLHAFLDERVWAMRQEEAHSDTSRVDTAQRVFLNEGNLDLEPPLDWHVYGDAYHIG

SEQ ID NO: 43596 - protein, 400 aa, Streptomyces coelicoflavus ZG0656
MLRLRAIMASGVAAAALVVSSGAVSAHGTTGADSPAPGGSYQARMVRALGDSLGISDASAARRLDSQARQQSVLGTLRSSGADPRGAFFDEDGRLTVNVTDASTARVVEAAGLEARTARHTADELDAVKAALDEAAKRELPTGVQGWGVDPVTNKVVVRVRDTATAADREFLDKAASYGSAVAVQDSDGKAVSMAGTVYPGSRMDYGNHYCSVGYGARDASGRQVLVTAGHCVENLPDLYYDGSHFAKGTTTRFHHGRNSVDMGLASVDAGWTVAPLVGTWNNGGDIAVEGSRRAPVGSDVCKSGATSGWTCGSIKAYDYSVTYTDPGQPATLVTNLGLSNACDLGGDSGGPWISGNQGQGMTSGGQTDNRCNGVYGQGTSYFQPLDDTLRYYGLSLNTA

SEQ ID NO: 43597 - protein, 241 aa, Streptomyces coelicoflavus ZG0656
MLMTSGASSAQAATWPTPNGSEGVSSTIPVSGTEDYGMKRLYGTGDLGSGGQDEDQGPILELAPGAVLKNVIIGAPAADGVHCKGSCTLQNVWWEDVGEDAATFRGSSSSNVYTVSGGGAKEAGDKVFQFNGAGTLNVSGFAVKNFGTFVRSCGNCSTQYKRTINLSGIEVNWKGGRIAGINTNYGDSATLRGITIVGDSGKKIVPCQKYIGNDDGDEPDSNGSGADGTHCKYSSSDITYK

SEQ ID NO: 43598 - protein, 383 aa, Streptomyces coelicoflavus ZG0656
RQSDGRAERRRRARCAGREEGSSLRRLLPRALVVVFLAGGTTAFVAKDKAVELTVDGTPRTLHTFADDVTELLAEEGVQVGAHDVIEPAPGAPLTSGEDVTVRHGRPVLLTLDGHRRQVWTTAETVEGALRRLGVRTQGAHLSTEPSRRIGREGLALVVRTERVVTVMADGRTRTVRTNAATVGEVVEEAGVTLRGEDTTSVAASAYPRDGQTVTVLRITGTREVREDQIPFDERRDEDATLYRGAEVVEQAGRPGLRRTTYALRTVNGVRQKPRRLSTEVVREPSPRVVRVGTRPRPASVHGADSLNWQALAACESGGRPDAVDPSGTYGGLYQFDTGTWHALGGEGRPQDASAAEQTYRAQKLYVRSGTSAWPHCGARLRG

SEQ ID NO: 43599 - protein, 397 aa, Streptomyces coelicoflavus ZG0656
MRHARRRIVRRAARLAAVGGLLLGGTMVTRAVAGEAPGPSAAPRTLAQTASGAGAGLVARLGGDRTAGHWVDADGRPVVAVTDGSTAEAVRRAGATAKEVRHSMTELRSAAATLRSAPRVPGTAWALDYRSNEVVVRGDRTVSGADWSRLTGVAEGIGGFVRMERTEGVFTTRLNGAEPILSTAGRCSAGFNVTDGTSDFILTAGHCGPTGSVWFGDGKGDRRIGRTVAGSFPGDDFSLVEYAGGKAGDAADVVAVGGGKGVRITGTGEPAVGQRVFRSGSTSGLREGRVTALDATVNYPEGTVTGLIETDVCAEPGDSGGPMFSEGVALGVTSGGSGDCAKGGTTFFQPLPEAMAALGVRLVVSGRDGAAAGTSAPPATGAAGAGASGAGASAPAT

SEQ ID NO: 43600 - protein, 232 aa, Streptomyces coelicoflavus ZG0656
MRISLPLLSTAVGLGLTAAVLGTGPAATAAAPQEPVRAAQASQAGYLPSAGSGEDAAANRAFFEAVVKSVAKKRAADASPSAAASVTVYYSAANAPSFRTQISRSAQIWNSSVSNVRLAESSSGADFAYYEGNDSRGSYASTDGHGRGYIFLDYRQNQQYDSTRVTAHETGHVLGLPDHYSGPCSELMSGGGPGPSCTNPYPNSNERSRVNQLWAYGFQAALDKALEKTSQR

SEQ ID NO: 43601 - protein, 316 aa, Streptomyces coelicoflavus ZG0656
KEKLDAAAVRTRTRQTPVWYVDVKTNRVTVQATSESAATAFLAASGVSGRDVAVRVSPDQPRVLEDLVGGDAYYIDGQARCSIGFSVTKDDQQGFATAGHCGDPGATTTGFNEAAQGTFQASTFPGKDMAWVGVNSDWTATPDVKAQDGEKIQIAGSVEALVGASVCRSGSTTGWHCGTVQQHDTSVTYPEGTVDGLTQTTVCAEPGDSGGPFVSGTQAQGTTSGGSGDCTNGGTTFYQPINPLLSDFGLTLKTTSAASGTPAPQDNAAADAWAAGRVYQVGTTVSFDGVRYRCLQSHQAQGAGSPASTPALWQRV

SEQ ID NO: 43602 - protein, 355 aa, Streptomyces coelicoflavus ZG0656
WVRGAESGTLTVATTDAADVAAIEARGAEAKVVRHSLTDLDAAKARMDKAAAGLNTADAPVWYVDTRTNTVVVEAIRPAVAHKLLAAAGVDGSLSRVEKRTERPRTFYDLRGGEAYYINNSSRCSIGFPVTKGTQQGFATAGHCGRTGSSTTGSNRVAQGTFQGSIFPGRDMAWVATNSSWTATPYVLGAGGQNVQVTGSTVSPVGASVCRSGSTTGWHCGTVTQHNTSVTYQEGTISPVTKTTVCAEPGDSGGSYISGSQAQGVTSGGSGDCRSGGETFFQPINALLQNYGLTLKTTGGGDDGGEEPGGTWAAGTVYQAGDTVTYGGATYRCLQGHQAYTGWEPPNVPALWQRV

SEQ ID NO: 43603 - protein, 660 aa, Streptomyces coelicoflavus ZG0656
MTDALDPAWLPDDAFRAVGTRRTLVRGTGPLADTVRGEVAAACARFGGALVDEGAPAGLVLELTDGGASGVGPGGVGDFGDEGFGYARADGRATVTASGGHGLLYGLFHVVRLGEAAFLGGPVREEHRPALALRMLDHWDNVAVHPVMGQVERGYAGGSLFWSDGRARDALDRVRAYGRLLAACGINAVCVNNVNVHETEAHLLTDRIGEVAAIAAALRPYGVRTHLSVTFAAPVVLGPLPTADPLDARVRGWWAGVTERVYEAVPDFGGYVVKADSEGQPGPFAYGRTHADGANLLAAALAPYGGTVHWRAFVYDHRQDWRDRSTDRARAAYDHFVPLDGEFAANAVLQVKHGPMDFQVREPVSPLIGAMPGTRLAVEVQATQEYTGQQRHVCWLGPMWSEVLRFRPDGEVAVGRLADALVAVSNVGDDPFWTGHPLAQANLYTFGRLAWDPAADPRAVLDEWIALTHPGAGRRLTEGLHAVLDGSWAAYEKYTAPLGVGFMVQPGHHYGPSVDGYEYSPWGTYHFADRDGVGVDRGAATGTGYAAQYAEPWAKLFESPGTCPDELLLFFHHVPYGHVLHSGKTVIQHIYDTHFEGVEEAEEARRVWAGLADLVEPARHARVAKRYEEQVRSAREWRDQVNSYFLRKSGVPDERGRTIH

SEQ ID NO: 43604 - protein, 507 aa, Streptomyces coelicoflavus ZG0656
MRRMRSIRAALTAAATAVAAMGLALSGTGPAQAATPLPDRVFAPYFEAWTGESPAALAAQSGAKHLTMAFLQTAAPGSCTPYWNGDTSMPIAQSTFGTDFDTIQANGGDVIPSFGGYTADTTGTEIADSCTDVQQIAAAYEKVITTYDVSRLDMDIEIDALDNTAGIDRRNKAIKLVQDWAAANGREIEISYTLPTTTRGLASNGVALLENAVRNGTKVDVVNLMTFDYYDNQPHDMAKDTQTATQGLHDVLARLYPDKSSAELWHMIGVIEMIGVDDFGPAETFTLDNARTVYDWALERGINTLSFWALQRDNGSCAGGGAADNCSGIQQNTWDFSHIFAPFTSGSTAPENDFSLSATPASGTVTAGASAATTVKTAVKSGRAETVRLTASGVPAGVTASFSPASVTAGGQSTLTLATTDRAVSGTYSVTVTGTSPSGSHSTTYSLTVTGGDGSQCTAAPWSSGAIYTGGQQVSHEGHTWKAKWWTTGEEPGTTGQWGVWQDLGAC

SEQ ID NO: 43605 - protein, 767 aa, Streptomyces coelicoflavus ZG0656
MRKSFVRRRLGAALPLALTVAMGVGLLTQPADALPEGPAAGSRTADTSGKHAGPPPVARSVGSGAGHVGKGRLEASALPPLAAGKDALKHSYGTPEAHGRPQGADGTRTAAAACDVSAFTTRTGSALVQQIKSSTTDCVNTLFDLTGNDAYHAFREAQMISVADALRDGSASYPGNAGTGMPQLVLYLRAGYYVHYYNAGTVGGYGSGLRTAIRAGLDAFFAAPHSRDVSDANGETLAEAVTLIDSAEENARYIHVVERLLADYDSSWNSSWWMLNAVNNVYTVTFRGHQVPAFVTAVESDPGLLDALYGFASGHLSLLGTDQSYLTSNAGRELGRFLQHSTLRSKVRPLATGLLDSSSITGATAPLWVGVAEMTAFYDEANCSSYGTCDLPAQLAKAVLPVTYACSSGITVRAQQMTSGELSAACDSMRGQDAYFHSVVRDDGPVAGDTNDSIEVVVFDSSTDYQTYAGAMYGIDTNNGGMYLEGDPSAAGNQPRFIAYEAEWLRPDFQIWNLNHEYTHYLDGRFDMYGDFNANITTPTIWWVEGFAEYVSYSYRGVPYTEATTEAGRGTYALSTLFDTTYSHDTTRVYRWGYLAVRYMLENHRADMDTVLGHYRAGNWNAARAYLTGTIGTRYDNDWYTWLAGCAAGDCGTGTGPGAECTGTDTRELGRDCRRSDQSAGKGDYAYLYLHVPAGTARLTITTSGGTGDADLYYGDGGWPGTGGYTRRDTGTGNSHTLTVDNPAAGTHYISLYAVDGFSGVTVGTDY

SEQ ID NO: 43606 - protein, 239 aa, Streptomyces coelicoflavus ZG0656
MRMKRRVTAAVGALVAPMVALSLPAPTASAHGWVVSPGSRQDQCANRVVQCGPIKWEPASVEGPKGLRNCSGGDARWADLDDDGKGWRVTPIGTTHTFTWTIEARHATSNWQYFIGNQKIAQFDGHGAQPPASVSHQLDFTGFGGQQKVLAVWNIADTANAFYACIDVNIGGGDDGGGDGGGGDQPGDCVAGAWSAGGVYTGGETVSHAGHTWRAKWWVTGEEPGTTGEWGVWEDLGAC

SEQ ID NO: 43607 - protein, 311 aa, Streptomyces coelicoflavus ZG0656
MFTPVRRRVRTAALALSAAAALVLGSTAASGASATPSPAPAPAPVKQGPTSVAYVEVNNNSMLNVGKYTLADGGGNAFDVAVIFAANINYDTGTKTAYLHFNENVQRVLDNAVTQIRPLQQQGIKVLLSVLGNHQGAGFANFPSQQAASAFAKQLSDAVAKYGLDGVDFDDEYAEYGNNGTAQPNDSSFVHLVTALRANMPDKIISLYNIGPAASRLSYGGVDVSDKFDYAWNPYYGTWQVPGIALPKAQLSPAAVEIGRTSRSTVADLARRTVDEGYGVYLTYNLDGGDRTADVSAFTRELYGSEAVRTP

SEQ ID NO: 43608 - protein, 392 aa, Streptomyces coelicoflavus ZG0656
MRRSRLRHLGLAGLLVLGGLTAAGTLPASAADASSTSPSASSDREPASAGLLDAMQRDFGLSRAEAEDRLAAERDATGLEPVARRAAGTAFGGSWFDADAGELTVALTSDAAPSTAQAVRATGAQVRTVEHSARQLDAAKARVDRLDAPAGVSSWRVDHSANTVVVDVVKSERADNDVQNFLERAREAGPVTVRSVPSAPRTFAAGTVGGDPYYTGNVRCSIGFSVHGGFVTAGHCGRAGAGVSGWDRSYIGTFQGSSFPDNDYAWVSVGSGWWTVPVVLGWGTVSDQLVRGSNVAPVGASICRSGSTTHWHCGTVLAHNETVNYSDGSVVHQLTKTSVCAEPGDSGGSFISGDQAQGVTSGGWGNCSSGGETWFQPVNEILNRYGLTLHTA

SEQ ID NO: 43609 - protein, 296 aa, Streptomyces coelicoflavus ZG0656
MSRRRISAVVTALALAGAVPLLAPADEASAAACSSYPAWSADANYNTGDIVRYTDGKAYIAEHANPGYDPLISTWYWDPYACDGGSQTPVGDFVVSEAQFNQMFPGRNSFYTYSGLTAALSAYPGFANTGSDTTKKQEAAAFLANVSHETGGLVHIVEQNTANYPHYCDWNQPYGCPAGQAAYYGRGPIQLSWNFNYKAAGDALGIDLLGNPWLVQNDAAVAWKTGLWYWNTQSGPGTMTPHNAMVNGAGFGQTIRSINGSLECDGKNPAQVQSRVTKYQQFAQILGVSPGGNLYC

SEQ ID NO: 43610 - protein, 789 aa, Streptomyces coelicoflavus ZG0656
MPSPSRSRSRHRAGPALFAAVAAVAGLLLAGLPATASQAAAQDSCRPDGLYQTPGVDVPYCSVYDADGREKMGADHPRRVIGYFTGWRTGKDGKPAYLASDIPWDKITHINYAFAHVDGGNKLSVGSDGAKNAATGMTWPGVAGAEMDPDLPYKGHFNLLNKFKKQHPDVKTMISVGGWAETGGYFADDGSRVDSGGFYSMATNADGSVNRAGIDTFADSAVDFVRKYGFNGVDIDYEYPTTMKDAGNPLDWSFANGRRAGLVKGYAALMKSLREKLDRAGAADGRHYLLSVAAPSSGYLLRGMETFQVQKYLDYVNIMSYDLHGAWNEYVGPNASLFDDGKDAELAAANVYGSAQYGGIGYLNTDWAYHYFRGSMPAGRINIGLPYYTRGHKNVQGGTDGLWGKAPASTCPAGSGLTKCGDGAVGIDNLWHDLDANGKESPAGSNPMWHAKNLEKGIVGDYVTDYGFPADTKLTGTYARKYDATLVAPWLWNAEKKVFLSTEDEQSVGAKADYVVDRGIGGAMIWELAGDYGWNAAKGQYEMGDTLTSLMYDTFRSAAPYGAKKSNADLPTEAVDVDVEFTDFKLGDSNYPITPKLRITNNTKTALPGGTEFQFDYGTSAPGNASDQSGFGTKVISSDHTGGNAGGLKGDFHRVSMKLPAWQSLAPGATVDLAFNYYLPVSTPSNWTVTIGGKAYALAGDLARGTTVVDPGTETPAPTPTDTQSPTPGPSPTDGTGQCTVPAWDAGASYGGGTTVSHQGHTWKAKWWTKGEEPGTTGEWGVWQDLGAC

SEQ ID NO: 43611 - protein, 348 aa, Streptomyces coelicoflavus ZG0656
MVGAGITALVAAGVTLQSANASEAPKTAAPETLSVTAAGKLASTLIGDLGTDAAGTYYDAQAKSLVVNVLDQAAAQTVEEAGAKARVVENSLADLKSARTTLTEDATIPGTSWATDPTTNKVVVTADRTVSKAELAKLTKVVDGLGAKAELKRTKGEYKPFVAGGDAITGGGGRCSLGFNVTKGGEPYFITAGHCTESISTWSDSSGNVIGENAASSFPDNDYGLVKYTADVDHPSEVNLYNGSSQAISGATDATVGMQVTRSGSTTQVHDGTVTGLDATVNYGNGDIVNGLIQTDVCAEPGDSGGSLFSGDQAVGLTSGGSGDCTSGGETFFQPVTEALSATGTQIG

SEQ ID NO: 43612 - protein, 302 aa, Streptomyces coelicoflavus ZG0656
MRIKRTNPRSGITRRTRLIAVSTGLVAAAAIAIPSANAAPTPATFSTAELNSASGAVLQADVPGTAWAVDAKSGRVLLTVDSTVSQAEIAKIKEQAGDKAGALTIKRTPGTFNKLIQGGDAIYASSWRCSLGFNVRTSSGAEYFLTAGHCTDGAGTWWSNSGHSTVLGSTAGSSFPGNDYGIVRYTNSSVSKPGTAGGVDITRAATPSVGTTVIRDGSTTGTHSGRVTALNATVNYGGGDIVRGLIQTTVCAEPGDSGGPLYGSNGTAYGLTSGGSGNCSSGGTTFFQPVTEALNAYGVSVY

SEQ ID NO: 43613 - protein, 306 aa, Streptomyces coelicoflavus ZG0656
MKRVGVLLLGALPVIAAGVYLAVPDDSADPADTAAAASSSAPATAKSARDDAKGRAEEEREADDALIADLPPGLAAPAKKELAQQLVSSAENSTTKWRTAYGSIQDVGDGDGYTAGIVGFCTGTHDLLTLVERYTEAHPDNGLAGYLPALREVDGSDSHEGLDPGFTAAWKAEAEVPAFRAAQEEERDRVYFEPAVRLAKLDGLGTLGQFVYYDAMVFHGPDTDAEGFYGLRERAMAKARTPGQGGAEKAYLDAFLDVREQAMEAKRPGIDTSRVGTAQRRFLAAGNMKLATPLVWEMYGDTYRVP

SEQ ID NO: 43614 - protein, 486 aa, Streptomyces coelicoflavus ZG0656
MRSLTPRGALGRCVLAAAFALAAGLTTLSPLAPPAAAADGLQQVTDFGPNPGNLAMYEYAPAGLPADAPLVVAMHGCTQSASDYHSHSGWQKFADAWGFAVVYPQTSAANNSLSCFNWFDPAEDTRGRGEAASVVQMVEHAAARYGTDRDRVFVTGLSAGGGMTSNLLAAYPDVFAGGAVNSGLPAQCATSVSAASGCQYSDQRLTPEQWGDKVRGSYPGYTGPWPRVAIWQGTADRTVAPVNGTELRDQWTDVWGTGQTASGTRTLPGGTTETTYDDSTGQPAVALFSVAGMAHGLAVSPGSGADQCGSTGTYYLNHICSSYYTGKFWGLDDAPDDGGATLPAPAGLTVTGTTDTGASLSWSAVNGAASYAVYRDGTKVGSPTGTSFSDTGLSAGTAYRYTVAAIDSSGAEGARSGAVTATTTGAAAKCYTATNYHHVTAGRAHHSGGYTYANGSNQNMGLYNVFVTHTLKETSPGYFVLADGGC

SEQ ID NO: 43615 - protein, 426 aa, Streptomyces coelicoflavus ZG0656
MPSIDVVVAREILDSRGNPTVEVEVGLDDGSTGRAAVPSGASTGAFEAIELRDGDQSRYLGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKNKGLATGLGDEGGFAPNLGSNREALDLILEAIKEAGYTPGEQIALALDVAASEFYKDGSYSFEGKDRTAAEMTEYYAELVEAYPLVSIEDPLFEDDWDGWKTITAKLGDKVQLVGDDLFVTNPERLARGIEENSANALLVKVNQIGSLTETLDAVELAQRNGFKCMMSHRSGETEDVTIADLAVATNCGQIKTGAPARSERVAKYNQLLRIEEILDDAAVYAGRSAFPRFKG

SEQ ID NO: 43616 - protein, 242 aa, Streptomyces coelicoflavus ZG0656
MLFSGKGKHRRPSKATRVIAVAGVTGAAVAAPLMAAGNASAATASEWDAVAQCESGGNWSINTGNGYYGGLQFSASTWAAYGGTQYASSADQASKSQQIEIAEKVLAGQGKGAWPVCGTGLSGAAYTGGGSEDSGSSSSESSQSQSGGSTAERSTEQKASRSSERPAAEPKAEEPAKKTVTTPTGKKVEKGDGEYKVVKGDTLSSIAEEHDVKGGWAKLFKLNDDIVDDADLIYPGQQLHLK

SEQ ID NO: 43617 - protein, 342 aa, Streptomyces coelicoflavus ZG0656
MLSGNGRHRRPRQAPALVVAAGVTGSAIAIPLLGATGAHAADGANWDRVAECETGGAWSQNSGNGYYGGLQLSQEVWEQYGGLDYAPSADQASRSQQIRIAEKIHADQGIAAWPTCGLLAGLGNGPGVSSGGSDASGDGASEGTDASGETDGSGASESPTNTEKPESSQSPESSEPSQPSGTTDSADTSESASGAPSSSPSPTSSPSSGTPSEASPDDAPPSTKSDTPTESDLGAGAERPDAEGSSGSGRHRGDSADEGAADRSRADDATGRHASRDGEPREVEDGSYTVRSGDNLWAIADSLEVDGGWRALYAGNKAVVGADPDHILPGQTLTVTGESGEK

SEQ ID NO: 43618 - protein, 274 aa, Streptomyces coelicoflavus ZG0656
GGDRGISRKTLLRAAVAAGAAVPLLATGGVALARDAARSSGGQTLTPTPYCDDGDDLTPDQMEGPYFKPNSPLRTSLVTPGTPGTPLTVSGYVFGRNCVPLSGVLLDFWQADDNGDYDMAGYTFRGHQFSDATGAFALKTIVPGLYPGRTRHIHVKVQAPGEPVLTTQLYFPGEPRNSTDMIFDPALLMNVRGAGGGKEGTFDFVLNVDGDTGPTDPPTDPPTDPPGGTWTSGHAYTSGDRVTYGGRSYRCLQAHTSMTGWEPPNVPALWQPES

SEQ ID NO: 43619 - protein, 107 aa, Streptomyces coelicolor
YAPSALVLTVGHGESAATAAPLRAVTLTCAPTASGTHPAADAACAELRAAHGDPSALAADDAVMCTREYAPVVVTVDGVWQGRRLSYERTFANECVKNAGSASVFTF

SEQ ID NO: 43620 - protein, 215 aa, Streptomyces coelicolor
MRMTRAASALAGLGLAVAAALGSVAPASAAAETSTPRSVAAYEASTENAAATRAFQEAVMKAVAEKRAANPGALAVTVTYDASAAPTFRSQIASSTSIWNGAVSNVRLQEGSNADFTYREGNDPRGSYASTEAHGRGYIFLDYAQNQQYNSTRVTTHETGHVLGLPDTYSGPCSQLMSGGGPGPSCTNAQPDSAERSRVEQLWANGLAEAAAEVR

SEQ ID NO: 43621 - protein, 296 aa, Streptomyces coelicolor
VSRRRISAVVTALALAGAVPLLMPANEASAASCSSYHAWSADANYNTGDIVRYTDGKAYIAEHANPGYDPLISTWYWDPYACDGGSQTPVGNFVVSEAQFNQMFPGRNSFYTYSGLTAALSAYPGFANTGSDTTKKQEAAAFLANVSHETGGLVYIVEQNTANYPHYCDWNQPYGCPAGQAAYYGRGPIQLSWNFNYKAAGDALGIDLLGNPWLVQNDAAVAWKTGLWYWNTQSGPGTMTPHNAMVNGAGFGQTIRSINGSLECDGKNPAQVQSRVTKYQQFAQILGVSPGGNLYC

SEQ ID NO: 43622 - protein, 507 aa, Streptomyces coelicolor
  strain ATCC BAA-471 / A32 / M145
MRRMRSIRAALTAAATTVAAVGLALSGTGPAQAATPLPDRVFAPYFEAWTGESPAALAAQSGAKHLTMAFLQTATPGSCTPYWNGDTSMPIAQSTFGADFDTIQANGGDVIPSFGGYTADTTGTEIADSCTDVQQIAAAYEKVITTYDVSRLDMDIEIDALDNTAGIDRRNKAIKLVQDWAAANGRDLEISYTLPTTTRGLASNGVALLENAVKNGTKVDVVNLMTFDYYDNQQHDMARDTQTATQGLHDVLARLHPGKSSADLWHMIGVIEMIGVDDFGPAETFTLDNARTVYDWALDQGINTLSFWALQRDNGSCAGGGAADNCSGIQQNTWDFSHVFAPFTSGSTAPENDFSLSATPASGTVTAGASATTTVKTAVKSGTAQTVQLGASGVPAGVTASFSPASVTAGGQSTLTLATTGQAVSGTYSITVTGTGPSGSHSTTYALTVTGGNGNQCTAVPWNSGAIYTGGQQVSHEGHTWKAKWWTTGEEPGTTGQWGVWQDLGAC

SEQ ID NO: 43623 - protein, 865 aa, Streptomyces coelicolor
  strain ATCC BAA-471 / A32 / M145
MRKSLVRRGLGAALPLALTVAMSVGLLSQPAGAAGNTGSVVHVAADDPEHAGPPPVAQSPTAETEHVAQGRTRASELPPVAASKDALKEVYGKTAKAPVRPSKSTDKAVAGKTGNSRARAAACNVSDFTSRSGGALVQQIKASTTDCVNTLFNLTGNDAYYAFRESQMTSVAYALRDGSTSYPGNASTGMPQLVLYLRAGYYVHYYNAGTVGTYGSSLQTAIRAGIDAFFASPHSRDVNDANGETLAEAVTLIDSAEENARYIHVVKRLLADYDSTWNSSWWMLNAVNNVYTVTFRGHQVPAFVSAVQSDPGLIDALYNFASGHLALLGTDQSYLTSNAGRELGRFLQHSALRSKVSPLAGGLLNSSSIKGRTAPLWVGVAEMTDYYDKANCSYYGTCDLQAQLARSVLTVTYPCSSSITIKAQQMTSGELSSSCSSLRNQDAYFHNVVRDNGPVANDNNSTIEVVVFDSSTDYQTYAGAMYGIDTNNGGMYLEGNPSAAGNQPRFIAYEAEWLRPDFQIWNLNHEYTHYLDGRFDMYGDFNANITTPTIWWVEGFAEYVSYSYRGVPYTEATTEAGRRTYALSTLFDTTYSHDTTRIYRWGYLAVRYMLENHRADMDTVLSHYRAGNWNAARSYLTGTIGTRYDNDWYTWLAACAAGNCGGGGTNPPGNQAPTAAFTTAVQGLNVTFTDQSTDADGTIASRSWSFGDGTTSTATNPVKTYGSAGSYTVKLTVTDDKGATATATRTVTVGSGGGGGTECNGTDTRELGQNCQRGNQSATTGNYAYLYLYVPAGTTQLKITTSGGTGDADLYYSTSGWPGTTSYTQRATGAGNNHTLTITNPPAGANYISLHAVSSFSGVTVSSAY

SEQ ID NO: 43624 - protein, 475 aa, Streptomyces coelicolor
  strain ATCC BAA-471 / A32 / M145
MHRGSLSRGHTSAVLAAVVAALAALAALLVATTPAQAAGSGALRGAGSNRCLDVLGGSQDDGALLQLYDCWGGTNQQWTSTDTGRLTVYGDKCLDVPGHATAPGTRVQIWSCSGGANQQWRVNSDGTVVGVESGLCLEAAGAGTANGTAVQLWTCNGGGNQKWTGLTGTPPTDGTCALPSTYRWSSTGVLAQPKSGWVALKDFTTVTHNGRHLVYGSTSSGSSYGSMVFSPFTNWSDMASAGQNAMNQAAVAPTLFYFAPKNIWVLAYQWGSWPFIYRTSSDPTDPNGWSAPQPLFTGSISGSDTGPIDQTLIADGQNMYLFFAGDNGKIYRASMPIGNFPGNFGSSYTTIMSDTKANLFEGVQVYKVQGQNQYLMIVEAMGANGRYFRSFTASSLSGSWTPQAASEGNPFAGKANSGATWTNDISHGDLVRDNPDQTMTVDPCNLQFLYQGKSPNAGGDYNSLPWRPGVLTLRR

SEQ ID NO: 43625 - protein, 776 aa, Streptomyces coelicolor
  strain ATCC BAA-471 / A32 / M145
MTPQRPTAPSRRAVLLAAAAAAALTTVPRAAAATADPYDALRRRWLGITLGTGYDPAAEPYASRLAETGERAREHRATMAPTPTSLWPGHPFDPPAGITFAYGRLWTMTEAYVQEGTGATGDPALLADILRGLDHLSATVYHPATTRYGNWWEWQIGSPRLLMDITAALYDHLGADRVAAACAAVDHFVPDAMLGAYTGTSTGANRVDLCRSVALRGVLGRAPAKIALARDALSPVFPYVTKGDGLYADGSFVQHTWVAYSGTYGQVMLDGLGRLFTLLAGSEWEVTDPGRQLVLDSVEHAYAPLIHDGLVMDTVNGRAISRGYLKSDDLHVMRSDHFHGQQLIAAMAVLAGGASNAERERWHARIKGWIERDTVTPVLTAPQFPVADLTRLHAIADAPGEAAPEPVGHHLFAAMDRAVHRRPAFTAGLAMASDRIAHYECGNGENPRGWHTGAGMLTWWANGTRADQYTDWFWPTVDWYRLPGTTVSTKRLADRAGGEWGAPKPDVRWVGGATDGEYAAVGQHLKGLGSTLEARKSWFFLDDAVVCLGAGITCADGVPVETVVDNRNLGEGGTQALVRGRHWAHLEGHGGWIVPGGALRTLREDRTGAWSDINTTSTTERRTRRWQTLWLDHGTDPAGADYVYTVMPGASRAALARRAADRHWLTVLANDDRRQAVSVPSLGLTAANFWQAGTAGPLTTTAGASVLVRRRGRTATLRVSEPPRTGEALEIVWDHPVGAVLRADETVEILATGRRLHLRVTPGVVCTTHECEVTLS

SEQ ID NO: 43626 - protein, 252 aa, Streptomyces coelicolor
  strain ATCC BAA-471 / A32 / M145
MRMKRRVAAAVGALVAPVVALSLPAPTASAHGWVVSPGSRQDQCANRVVQCGQIKWEPASVEGPKGLRNCSGGDARWADLDDDGKGWRVTPIGTMHTFTWTIEARHATSNWQYFIGDQKIAQFDGHGALPPASVSHQLDFGGFSGRQKVLAVWNIADTANAFYACIDVNIGGGNDGGGDDGGGGDGDGDGGGDGGGDQPGDCVAGPWSAGSVYNGGETVSHDGHTWRAKWWVTGEEPGTTGEWGVWEDLGAC

SEQ ID NO: 43627 - protein, 309 aa, Streptomyces coelicolor
  strain ATCC BAA-471 / A32 / M145
MVNRRDLIKWSAVALGAGAGLAGPAPAAHAADLEWEQYPVPAAPGGNRSWQLLPSHSDDFNYTGKPQTFRGRWLDQHKDGWSGPANSLYSARHSWVADGNLIVEGRRAPDGRVYCGYVTSRTPVEYPLYTEVLMRVSGLKLSSNFWLLSRDDVNEIDVIECYGNESLHGKHMNTAYHIFQRNPFTELARSQKGYFADGSYGYNGETGQVFGDGAGQPLLRNGFHRYGVHWISATEFDFYFNGRLVRRLNRSNDLRDPRSRFFDQPMHLILNTESHQWRVDRGIEPTDAELADPSINNIYYRWVRTYQAV

SEQ ID NO: 43628 - protein, 227 aa, Streptomyces coelicolor
  strain ATCC BAA-471 / A32 / M145
MRITLPLLSTAVGLGLTAAVLGTGPAATAAAPQEPVRAAQLGYQPSAGSGEDAAANRAFFEAVVKSVAEKRAANPSAAAAVTVYYSATNAPSFRSQISRSAQIWNSSVSNVRLAESSSGADFAYYEGNDSRGSYASTDGHGSGYIFLDYRQNQQYDSTRVTAHETGHVLGLPDHYSGPCSELMSGGGPGPSCTNPYPNSTERSRVNQLWAYGFQAALDKALEKASQR

SEQ ID NO: 43629 - protein, 144 aa, Streptomyces coelicolor
  strain ATCC BAA-471 / A32 / M145
MRNTARWAATLGLTATAVCGPLAGASLASPATAPASLYAPSALVLTVGHGESAATAAPLRAVTLTCAPTASGTHPAAAAACAELRAAHGDPSALAAEDSVMCTREYAPVVVTVDGVWQGRRLSYERTFANECVKNAGSASVFTF

SEQ ID NO: 43630 - protein, 300 aa, Streptomyces coelicolor
  strain ATCC BAA-471 / A32 / M145
MRIKRTTPRSGITRRTRLIAVSTGLVAAAAVAIPSANAAPAPATFSAAELSSAGNAVLQADVPGTAWAVDSKSGRVLLTVDSTVSQAEIAKIKEQAGDKADALTIKRTPGKFNKLIQGGDAIYASSWRCSLGFNVRTSSGAEYFLTAGHCTDGAGAWRASSGGTVIGQTAGSSFPGNDYGIVQYTGSVSRPGTANGVDITRAATPSVGTTVIRDGSTTGTHSGRVTALNATVNYGGGDVVGGLIQTTVCAEPGDSGGSLYGSNGTAYGLTSGGSGNCSSGGTTFFQPVTEALSAYGVSVY

SEQ ID NO: 43631 - protein, 458 aa, Streptomyces coelicolor
  strain ATCC BAA-471 / A32 / M145
MSRTQFEPAETYTAYTAYDEAYEAHEAYEAHEAYEAHETYERPAPYDLHSAPTLPYGGTYPSAPPPVHEPTVPALPRQSDGRAERRRRARGAGRADASLRRLVPRALVVAFLAGGTTAFVAKDKAVELTVDGSPRTLHTFADDVSELLAEEGVQVGAHDVIAPAPGTPLTSGEDVTVHHGRPVLLTLDGHRRQVWTTAGTVAGALRQLGVRTQGAYLSTGPSRRIGREGLALVVRTERVVTVMADGRTRTVRTNAATVGEVVEEAGITLRGEDTTSVPATGFPRDGQTVTVLRITGSQEVREDPIPFDERRAEDASLFRGTEVVQEAGRPGLRRTTYALRTVNGVRQKPRRLRTEVVREPSPRIVRVGTRPRPASVHGADHLNWQGLAACESGGRADAVDPSGTYGGLYQFDSATWHGLGGEGRPEDASAAEQTYRAQKLYVRSGADAWPHCGARLRE

SEQ ID NO: 43632 - protein, 1066 aa, Streptomyces coelicolor
  strain ATCC BAA-471 / A32 / M145
MLRQTAVAGTVLAMTLAGVVVPASLASASERSAPSAAEPSPVERAVAAADQAVRSGLDALVAGGPDEQYDRHQVTPWDKDLFSVAYERTYHGLPVVGGDAVVLADGKGRVRAVRSATEAAIAVPTEARIKSGQAVRTSRERLANVDEVDSGRLVVRVKDDVQTLAWETVLVGATKDHVPSKLHVFVDARTGKVVDSYDDVKAGTGHSEWNGPSPLTIDTSRSGSQYALRDTTRPGLQCSDYNGGLFTGPDDDWGTGNASSKETGCVDVMYAAQKESDMLRDWLGRNGHNGNGGSWPALVGLNQLNAYWDGSRVTIGHNSANKWIAGMDVVGHEYGHGLDSFTPGGANHESGLGEATGDIMGALTEAYANQPAGYDTPDYTVGEEIDLQGRGPIRNMYNPQLVNNDPNCYSSAIPRTEEHAAAGPMNHWFYLLAEGSSPGGGKPSSPTCDGSRVTGIGIQNAGKIFYGGMLLKTSGMTYKRYRSATLTAAKNLDASCDLFDATRAAWNAIDIPAQSGDPACTRQETDFSLALSPASGNVEAGSAVNATVNTTTVTGSAQQVSLTATGTPPGVSVSFSPSTVTSGSSSTMRVSTTSGTAAGTYSLTVKGTAGSKSHTAQYTLTVGGGNNPGTPPDVDVAQVQAHLAQFGSIAAQNGGNRRSTGSGYDASLAYVKGKLQAAGYTVTEQTCTSGCSAGAGNNLIAEWPKGDANSVYMFGAHLDGVSAGPGINDNGSGSAALLETALTLAEQNPTMDNRVRFAWWTDEEQGLNGSDFYARNLSTTDRSRIKAYYNFDMVASVNGGYFINNLSSSASAPMREYWTSLGLAPQENVEGQGRSDDYSFQQVGIPTSGYATGASAIKSSTEAAKWGGTAGRSYDPCYHSACDTTANISATALNRSADGIAYTIWKTAVGDAPNPQDDFSISANPSSGTVDPGSSASVTVNTATTSGDAQSVRLSASGAPTGVSVGFSPDSVTSGQSSTATVQVAAGTAGGTYTLTLTGAGTVTHTTTYTLTVSGDDGGETTWQLGATYAAGDVVSYNGVSYRCIQGHTAYPGWEPPNVPALWQRL

SEQ ID NO: 43633 - protein, 439 aa, Streptomyces coelicolor
  strain ATCC BAA-471 / A32 / M145
MAVRGRHRRYQPNRINRASLTVTAGGAGLALPLVGTGTAHAADAATWDKVAACESTDDWDINTGNGYYGGLQFTQSTWEAFGGTRYAPRADLATREQQIAGAEKVLDTQGPGAWPVCSERAGLTRGGDPPDIRPAGSAAPAQKTSDSVKDVQPQTTPQSRAGKARMYTVVTGDTLSGIADTHEVRGGWQRLYEANRSAIGSDPDLILPGQRLSLRGQGTTRAPGAEAGRRQDEQQPQRDKQRQKQQDKQQKQHRKEQKQEQKQEPKQEPKEQKRQEQKQQEQRKAPKESSSDSGKAKAAGKATAHRAVVAPVDAATGTPYHQAGSSWSKGYHTGVDFPVPTGTSVKSVADGRVVSAGWGGSYGYQVVVRHGDGRYSQYAHLSAISVKSGQSVGVGQRLGRSGSTGNVTGPHLHFEVRTGPGFGSDVDPVAYLRAGGVRI

SEQ ID NO: 43634 - protein, 295 aa, Streptomyces coelicolor
  strain ATCC BAA-471 / A32 / M145
MPKPALRRVMTATVAAVGTLALGLTDATAHAAPAQATPTLDYVALGDSYSAGSGVLPVDPANLLCLRSTANYPHVIADTTGARLTDVTCGAAQTADFTRAQYPGVAPQLDALGTGTDLVTLTIGGNDNSTFINAITACGTAGVLSGGKGSPCKDRHGTSFDDEIEANTYPALKEALLGVRARAPHARVAALGYPWITPATADPSCFLKLPLAAGDVPYLRAIQAHLNDAVRRAAEETGATYVDFSGVSDGHDACEAPGTRWIEPLLFGHSLVPVHPNALGERRMAEHTMDVLGLD

SEQ ID NO: 43635 - protein, 454 aa, Streptomyces coelicolor
  strain ATCC BAA-471 / A32 / M145
MRHARRRIVRRVARLAAVGGLLLGGTMVTRAVASEPPDASTAPRTFAQTPSGAGGDLVSRLGTGRTAGHWVDSEGRPVVAVTDERAAEAVRRAGATAKRVRHSMSELRSAASTLRSAPRVAGTAWALDYRSNEVVVRGDRTVSGSDWSRLTAVAEGIGGFVRMERTEGTFTTRLNGAEPILSTAGRCSAGFNVTDGTSDFILTAGHCGPTGSVWFGDRPGDGQVGRTVAGSFPGDDFSLVEYANGKAGDGADVVAVGDGKGVRITGAGEPAVGQRVFRSGSTSGLRDGRVTALDATVNYPEGTVTGLIETDVCAEPGDSGGPMFSEGVALGVTSGGSGDCAKGGTTFFQPLPEAMASLGVRLIVPGREGAAAGTSAPAGQAPGTRAPGASGAGAPAPAAGVDGSTLLARLTDRRNIGPGLLVVAGSLVALVATRWIREEQDRKAYRRRYSATWG

SEQ ID NO: 43636 - protein, 266 aa, Streptomyces coelicolor
  strain ATCC BAA-471 / A32 / M145
MTAVTRPRARRAVTGALGALGLSVGMLMTSGASSAQAATWPTPNGSEGVSSTLSVSGTKDYGMKRLYGTGDLGSGGQDEDQGPILELAPGAVLKNVIIGAPAADGVHCKGSCTLQNVWWEDVGEDAATFRGSSSSNVYTVSGGGAKEADDKVFQFNGAGTLNISGFAVKNFGTFVRSCGNCSTQYRRTINLNGIEVNWKGGRIAGINTNYGDSATLRNITIVGDSSKKIVPCQKYIGNDDGDEPDSNGSGADGTYCKYSSSDITYK

SEQ ID NO: 43637 - protein, 341 aa, Streptomyces coelicolor
  strain ATCC BAA-471 / A32 / M145
MLSGNGRHRRPRQAPALVVAAGVTGSAIAIPLLGATGAHAADSTNWDQVAECETGGAWSQNSGNGYYGGLQLSQDAWEQYGGLDYAPSADQASRSQQIRIAEKIHASQGIAAWPTCGLLAGLGNGSGGTGDGSGAAGDGASEGSDASGEQDTTKSSESPATTETPESSQSSESSGSSETPESTSGASSSSPSPSSSPSSSDAPSDGSSGASGDSSDGAGQSAKPDTSTESDPSGSAEPQGTEGSSGSGKHRGGSADEGATGEGRTDPASGRHASRDGGEREAGDGRYVVRTGDSLWAIADSLDVDGGWHALYADNETVVGADPDHILPGQTLTVTGESGEK

SEQ ID NO: 43638 - protein, 244 aa, Streptomyces coelicolor
  strain ATCC BAA-471 / A32 / M145
MLFSGKGKHRRPSKATRVIAVAGVTGAAVAAPLMAAGNASAATASEWDAVAQCESGGNWSINTGNGYYGGLQFSASTWAAYGGTQYASTADQASKSQQIQIAEKVLAGQGKGAWPVCGTGLSGAAYTGGGSEGSGSGSSEGSQSQSSGSTAERSTEQKASRSAERPAAEPKAEKPAAKKKTVTTPTGKKVEKGDGEYKVVKGDTLSSIAEEHDVKGGWAKLFKLNDDIVDDADLIYPGQQLHLK

SEQ ID NO: 43639 - protein, 426 aa, Streptomyces coelicolor [sequence omitted]

SEQ ID NO: 43640 - protein, 434 aa, Streptomyces coelicolor [sequence omitted]

SEQ ID NO: 43641 - protein, 182 aa, Streptomyces coelicolor
  strain ATCC BAA-471 / A32 / M145
MHVRTLTGCLAAALLSLPLLSGQAVAAESPAAARVLTYDASGSAEFRSAVDRGAAIWNESVENAELRPVSAGQRADIRILADDGWPRALPTSLGKGTVWIGRQAVDEGYNTVRISSHELGHILGLPDRKPGPCSSLMSGSSAGVPCTNPYPNAAEKAEVEDNFAGAAGSRAVAGPVPVLIED

SEQ ID NO: 43642 - protein, 309 aa, Streptomyces coelicolor
  strain ATCC BAA-471 / A32 / M145
MKFTPVRSRVRRAALALSAVAALAVGTTATAATTGAAAAPAPRKQGPTSVAYIEVNNNSMLNAGKYTLADGGGNVFDVAVIFAANINYDTGTKSAYLHFNENVQRVLDNAATQIRPLQQKGIKVVLSVLGNHQGAGFANFPSQQAASAFARQLSDAVAEYGLDGIDFDDEYAEYGNNGTAQPNDSSFVHLVTALRANMPDKIISLYNIGPAASRLSYGGVDVSTDFDYAWNPYYGTWQVPGIALPQSKLSPAAVEIGRTSQSTSAELARRTVDGGYGVYLTYNLDGSDRSADVSAFTRELYGSEAVRTP

SEQ ID NO: 43643 - protein, 541 aa, Streptomyces coelicolor
  strain ATCC BAA-471 / A32 / M145
MRKSSIRRRATAFGTAGALVTATLIAGAVSAPAASAAPADGHGHGHGHGRSWDREARGAAIAAARAARAGIDWEDCAADWNLPKPIQCGYVTVPMDYAKPYGKQIRLAVDRIGNTGTRSERQGALIYNPGGPGGSGLRFPARVTSKSAVWANTAKAYDFVGFDPRGVGHSAPISCVDPQEFVKAPKADPVPGSEADKRAQRKLAREYAEGCFERSGEMLPHMTTPNTARDLDVIRAALGEKKLNYLGVSYGTYLGAVYGTLFPDHVRRMVVDSVVNPSRDKIWYQANLDQDVAFEGRWKDWQDWVAANDAAYHLGDTRAEVQDQWLKLRAAAAKKPLGGVVGPAELISFFQSAPYYDSAWAPTAEIFSKYVAGDTQALVDAAAPDLSDTAGNASAENGNAVYTAVECTDAKWPANWRTWDRDNTRLHRDHPFMTWANAWMNLPCATWPVKQQTPLNVKTGKGLPPVLIVQSERDAATPYEGAVELHQRFRGSRLITERDAGSHGVTGLVNPCINDRVDTYLLTGGTDARDVTCAPHATPRP

SEQ ID NO: 43644 - protein, 244 aa, Streptomyces coelicolor
  strain ATCC BAA-471 / A32 / M145
MRTKRRVAFAVGALVAPLLAVSLPASTASAHGWVTSPGSRQDQCAAGIVDCGQIKYEPQSVEGPKGLSSCSGGNSQFAELDDDGKGWRVTPVGTTHTFTWHHTARHATANWQYFIGSQKIAEFDGHRAQPAPDVSHQVNFGGFTGRQKVLAVWNVADTGNAFYSCIDVNIGGSGGGDGGGDGGGDGDPGACDAPGWSAGSVYSGGDTVSFGGHTWRAKWWVTGEEPGTTGEWGVWEDLGACAAA

SEQ ID NO: 43645 - protein, 463 aa, Streptomyces coelicolor
  strain ATCC BAA-471 / A32 / M145
MPHRHRHHRAVGAAVAATAALLVAGLSGSASAGTAPAGSAPTAAETLRTDAAPPALLKAMQRDLGLDRRQAERRLVNEAEAGATAGRLRAALGGDFAGAWVRGAESGTLTVATTDAGDVAAIEARGAEAKVVRHSLADLDAAKARLDTAAAGLNTADAPVWYVDTRTNTVVVEAIRPAAARSLLTAAGVDGSLAHVKNRTERPRTFYDLRGGEAYYINNSSRCSIGFPITKGTQQGFATAGHCGRAGSSTTGANRVAQGTFQGSIFPGRDMAWVATNSSWTATPYVLGAGGQNVQVTGSTASPVGASVCRSGSTTGWHCGTVTQLNTSVTYQEGTISPVTRTTVCAEPGDSGGSFISGSQAQGVTSGGSGDCRTGGETFFQPINALLQNYGLTLKTTGGDDGGGDDGGGDDGGEEPGGTWAAGTVYQPGDTVTYGGATFRCLQGHQAYAGWEPPNVPALWQRV

SEQ ID NO: 43646 - protein, 791 aa, Streptomyces coelicolor
  strain ATCC BAA-471 / A32 / M145
MPSPSRSRSRHRAGPALFAAVAAVAGLLLAGLPATASQAADQESCRPDGLYQTPGVDVPYCSVYDADGREKMGADHPRRVIGYFTSWRTGKDGKPAYLASDIPWDKITHINYAFAHVDGGNRLSVGSDGEKNAATGMTWPGVEGAEMDPGLPYKGHFNLLNKFKKQHPDVKTMISVGGWAETGGYFADDGSRVDSGGFYSMATKADGSVNQAGIDTFADSAVDFVRKYGFNGVDIDYEYPTTMKDAGNPLDWSFANGRRAGLVKGYAALMKTLREKLDRAGAADGRHYLLSVAAPSSGYLLRGMETFQVQKYLDYVNIMSYDLHGAWNEYVGPNASLFDDGRDAELAAANVYGSAQYGGIGYLNTDWAYHYFRGSMPAGRINIGLPYYTRGHKNVQGGTDGLWGRASASTCPAGSGLTKCGDGAVGIDNLWHDLDTNGKESPAGSNPMWHAKNLEKGIVGDYVTDYGFPADTKLTGTYARKYDSTLVAPWLWNAEKKVFLSTEDEQSVGAKADYVADRGIGGAMIWELAGDYGWNAAKGQYEMGDTLTSLMYDTFRSAAPYGAKKSDADLPVRAVDVDVEFTDFKLGDSNYPITPKLRITNNTRTALPGGTEFQFDYGTSAPGNASDQSGFGTKVIHSDHTGGNAGGLKGDFHRVSLKLPAWQSLAPGATVDLAFNYYLPVSTPSNWTVTIGGTAYALAGDLARGTTVVDPGTQTPTPTPTPTGTESPGPSPSPTDGTGQCTAPAWDTASSYGGGTTVSHQGHTWKSKWWTKGEEPGTTGEWGVWQDLGAC

SEQ ID NO: 43647 - protein, 121 aa, Streptomyces coelicolor
  strain ATCC BAA-471 / A32 / M145
MICRRNDRQSDVRGSRGRRIRTAAVTLVAATALGATGEAVAAPSAPLRTDWDAIAACESSGNWQANTGNGYYGGLQFARSSWIAAGGLKYAPRADLATRGEQIAVAERLARLQGMSAWGCA

SEQ ID NO: 43648 - protein, 390 aa, Streptomyces coelicolor
  strain ATCC BAA-471 / A32 / M145
MRRSRLRHLGLAGLLVLGSLTAVGTLPASAADAPAHSPSSSEQPASAGLLDAMQRDFGLTRAEAEDRLAAEREATGIEPAARRAAGKAFGGSWFDAEAGRLTVAVTSDATPSALRAVRATGAQVRTVEHSAQQLDAAKARVDRLDAPAGVSSWRADRATNKVVVDVVAGERADNDVQSFLKQARATAPVTVRTVPSAPQTFAAGTVGGDPYYTGNVRCSIGFSVHGGFVTAGHCGRAGAGVSGWDRSYIGTFQGSSFPDNDYAWVSVGSGWWTVPVVLGWGTVSDQLVRGSNVAPVGASICRSGSTTHWHCGTVLAHNETVNYSDGSVVHQLTKTSVCAEGGDSGGSFISGDQAQGVTSGGWGNCSSGGETWFQPVNEILNRYGLTLHTA

SEQ ID NO: 43649 - protein, 157 aa, Streptomyces coelicolor
  strain ATCC BAA-471 / A32 / M145
MKLLRKPAAVTVAALALAALPAAAAQAHDGAHPFKNCSEAYDAGYSNIKKGDEHYGEHLDRDKDGVGCDKPPAGFVPADGKDSGAKDTDDAADAGSGKDSGSEEGGGAEAAGQQGTDLAETGGDDSTPYLAAGGAVVVLAGGGLLLAARRRRSDGAA

SEQ ID NO: 43650 - protein, 241 aa, Streptomyces coelicolor
  strain ATCC BAA-471 / A32 / M145
MQQDGTQQDRIKQSPAPLNGMSRRGFLGGAGTLALATASGLLLPGTAHAATTITTNQTGTDGMYYSFWTDGGGSVSMTLNGGGSYSTQWTNCGNFVAGKGWSTGGRRTVRYNGYFNPSGNGYGCLYGWTSNPLVEYYIVDNWGSYRPTGTYKGTVSSDGGTYDIYQTTRYNAPSVEGTKTFQQYWSVRQSKVTSGSGTITTGNHFDAWARAGMNMGQFRYYMIMATEGYQSSGSSNITVSG

SEQ ID NO: 43651 - protein, 280 aa, Streptomyces coelicolor
  strain ATCC BAA-471 / A32 / M145
MRHPFRDPARPAGPSRRTVLAMACASLATVPLFTPSHAAAASARATGLDDPAKKEIAMQLVSSAENSSLDWKAQYRYIEDIGDGRGYTAGIIGFCSGTGDMLDLVELYGERSPGNVLAPYLPALRRVDGSDSHEGLDPGFPDDWRRAADQDPQFRRAQDDERDRVYFDPAVRRGKEDGLRTLGQFAYYDAMVMHGDGGGLGFGSIRERALGRARPPAQGGDEVAYLHAFLDERVWAMKQEQAHSDTSRVDTAQRVFLNEGNLDLEPPLDWHVYGDAYHIG

SEQ ID NO: 43652 - protein, 437 aa, Streptomyces coelicolor
  strain ATCC BAA-471 / A32 / M145
MSHKRIPKRRAAMAAGGVVALGAAAILLPNANASQDGGSSDDAAAAPRTLKAADASDLAARLAGLLGDSFAGSYYDSGARQLVVNVVPGDNNQVVVQAEKAGAKVREVDNSMGELRGGAQTLKAEAGIPGTAWAIDPRTNKILVTADSTVTGDRWDRLESTVDGLGSGMATVRKSAGTFKTFASGGDAIFGGGARCSLGFNVTAGDGSPAFLTAGHCGVAADQWSDAQGGQPIATVDQAVFPGEGDFALVRYDDPATEAPSEVDLGDQTLPISGAAEAAVGQEVFRMGSTTGLADGQVLGLDATVNYPEGMVTGLIQTDVCAEPGDSGGSLFTRDGLAIGLTSGGSGDCTVGGETFFQPVTTALAAVGATLGGEDGGAGAGDAGGAGAGAGEEGDAGGAGDAGDGGAGAGDKGDTGDAGDAGDGAPVGAGDGSGLTG

SEQ ID NO: 43653 - protein, 360 aa, Streptomyces coelicolor
  strain ATCC BAA-471 / A32 / M145
MKHRRIPRRRVAVVGAGITALVAAGVTFQTANASEAPKTAAPETLSVSAAGELASTLLGDLGADAAGTYYDAQAKSLVVNVLDQSAAQTVEEAGAKARVVENSLADLKSARTALTKDATIPGTSWATDPTTNKVVVTADRTVSEAELAKLTKVVDGLGAKAELKRTKGEYKPFVAGGDAITGGGGRCSLGFNVTKGGEPYFITAGHCTESISTWSDSSGNVIGENAASSFPDNDYGLVKYTADVDHPSEVNLYNGSSQAISGAAEATVGMQVTRSGSTTQVHDGTVTGLDATVNYGNGDIVNGLIQTDVCAEPGDSGGSLFSGDQAIGLTSGGSGDCTSGGETFFQPVTEALSATGTQIG

SEQ ID NO: 43654 - protein, 268 aa, Streptomyces coelicolor
  strain ATCC BAA-471 / A32 / M145
MRRFRLVGFLSSLVLAAGAALTGAATAQAAQPAAADGYVALGDSYSSGVGAGSYISSSGDCKRSTKAHPYLWAAAHSPSTFDFTACSGARTGDVLSGQLGPLSSGTGLVSISIGGNDAGFADTMTTCVLQSESSCLSRIATAEAYVDSTLPGKLDGVYSAISDKAPNAHVVVIGYPRFYKLGTTCIGLSETKRTAINKASDHLNTVLAQRAAAHGFTFGDVRTTFTGHELCSGSPWLHSVNWLNIGESYHPTAAGQSGGYLPVLNGAA

SEQ ID NO: 43655 - protein, 305 aa, Streptomyces coelicolor
  strain ATCC BAA-471 / A32 / M145
MKRAGVLLLGALPVIAAGVYFAVPDDSADPADTAAASSSSSATARSDRDDAKDRAEREREADDALIADLPPGLAAPAKKELAQQLVSSAENSTTKWRTAYGSIEDVGDGDGYTAGIIGFCTGTHDLLMLVERYTEDHPDNGLAEYLPALREVDGSDSHEGLDPGFTAAWKAEAEVPAFRAAQEAERDRVYFEPAVRLAKLDGLGTLGQFVYYDAMVFHGPDTDAEGFYGLRERAMAEARTPGQGGSEKAYLETFLDVRKQAMEAKRPGIDTSRVDTAQRRFLTAGNLKLATPLVWEMYGDTYRVP

SEQ ID NO: 43656 - protein, 296 aa, Streptomyces coelicolor
  strain ATCC BAA-471 / A32 / M145
MSRRRISAVVTALALAGAVPLLMPANEASAASCSSYHAWSADANYNTGDIVRYTDGKAYIAEHANPGYDPLISTWYWDPYACDGGSQTPVGNFVVSEAQFNQMFPGRNSFYTYSGLTAALSAYPGFANTGSDTTKKQEAAAFLANVSHETGGLVYIVEQNTANYPHYCDWNQPYGCPAGQAAYYGRGPIQLSWNFNYKAAGDALGIDLLGNPWLVQNDAAVAWKTGLWYWNTQSGPGTMTPHNAMVNGAGFGQTIRSINGSLECDGKNPAQVQSRVTKYQQFAQILGVSPGGNLYC

SEQ ID NO: 43657 - protein, 294 aa, Streptomyces coelicolor
  strain ATCC BAA-471 / A32 / M145
MTSDTPTTPDEPGPRPGPGSGADRGISRKTLLRAAVAAGAAVPLLATGGVALARDAARSGDGQRLTPTPYCDDGDDLTPDQMEGPYFKPNSPLRTNLVTPGTPGTPLTVSGYVFGRNCVPLSGVLLDFWQADDNGDYDMAGYTFRGHQFTGATGAFALKTIVPGLYPGRTRHIHVKVQAPGEPVLTTQLYFPGEPRNSTDMIFDPALLMNVRGAGGGKEGTFDFVLNVDGDTGPTDPPTDPPTDPPGGTWASGHAYTSGDRVTYGGRSYRCLQAHTAMTGWEPPNVPALWQSES

SEQ ID NO: 43658 - protein, 458 aa, Streptomyces coelicolor
  strain ATCC BAA-471 / A32 / M145
MVGRHAARSRRAALTALGALVLTALPSAASAAPPPVPGPRPAVARTPDAATAPARMLSAMERDLRLAPGQAAARLVNEAEAGTRAGMLRNTLGDRFAGAWVSGATSAELTVATTDAADTAAIEAQGAKAAVVGRNLAELRAVKEKLDAAAVRTRTRQTPVWYVDVKTNRVTVQATGASAAAAFVEAAGVPAADVGVRVSPDQPRVLEDLVGGDAYYIDDQARCSIGFSVTKDDQEGFATAGHCGDPGATTTGYNEADQGTFQASTFPGKDMAWVGVNSDWTATPDVKAEGGEKIQLAGSVEALVGASVCRSGSTTGWHCGTIQQHDTSVTYPEGTVDGLTETTVCAEPGDSGGPFVSGVQAQGTTSGGSGDCTNGGTTFYQPVNPLLSDFGLTLKTTSAATQTPAPQDNAAADAWTAGRVYEVGTTVSYDGVRYRCLQSHQAQGVGSPASVPALWQRV

SEQ ID NO: 43659 - protein, 202 aa, Streptomyces coelicolor
  strain ATCC BAA-471 / A32 / M145
MTGDFAFVDELVSGIRWDAKYATWDNFTGKPVDGYLANRIVGTKALCAALGRAQERAEDLGFGLLLWDGYRPQRAVDCFLRWSQQPEDGRTKARHYPNIGRAEMFDRGYVAARSGHSRGATVDLTLYHLTTGELAAMGGGHDLMDPISHHDARDVPRAEAANRRHLRSIMAACGFASYACEWWHYTLKEEPHPDTYFDFPIA

SEQ ID NO: 43660 - protein, 17 aa, Streptomyces coerulescens
GFIGWGNNIFGHYSGDF

SEQ ID NO: 43661 - protein, 301 aa, Streptomyces cyaneus [sequence omitted]

SEQ ID NO: 43662 - protein, 107 aa, Streptomyces cyaneus
  Streptomyces curacoi
YAPSALVLTVGEGESAAAATPERAVTLTCAPRPSGTHPVAGSACAELRGVGGDVHALTATDGVMCTKQYDPVVVTVDGVWQGRRVSYERTFSNECVKNAYGSGVFAF

SEQ ID NO: 43663 - protein, 714 aa, Streptomyces davawensis
MGADHQRRVIGYFTGWRTGKDGTPAYLAPDIPWDKVTHLNYAFAHIDGSNKISVGADSATNAATGMTWPGVNGAEMDPGFSYKGHFNLLNKFKKQHPNVKTLISVGGWAETGGYFDDSGTRVNSGGFYSMATNADGSVNQAGIDIFANSAVDFIRKYGFNGVDIDYEYPTTMKDAGNPLDWSISNARRAGLVKGYAVLMKTLREKLDRAGAADGKHYLLSVAAPSSGYLLRGMETFQVQKYLDYVNIMSYDLHGAWNEYVGPNASLFDDGKDAELAAAGVYSASQYGGIGYLNTDWAYHYFRGSMPAGRINIGLPYYTRGFKNVIGGTDGLWGKAATTNCPAGSGLTKCGDGATGIDNLWHDLDTNGKESPAGSNPMWHAKNLEKGVVGDYVTKYGFPADTRLTGSYARKYDSTLVAPWLWNAEKKVFLSTEDEQSVNAKADYVVANGIGGTMVWELAGDYGWNATKGQYEPGSTLTTAMYEKFKSASPYGATVSNKALPTQAVDIGVEFGEFKLGDSNYPITPKVKITNNTKSALPGGTEFQFDYSTAAPANASDQSGFGAKVISSDHTGSNVGGLKGDFHRVSLKLPSWQSLAPGASVELSFNYYLPVSTPWNWTVNISGTTYSLAGNLGRGTTLVEPGSGGTPTPDPTDPTPTPTPTPGACTAPAWNSTTEYGGGTQVSHKGHSWKAKWWTKGEEPGTTGEWGVWQDLGAC

SEQ ID NO: 43664 - protein, 56 aa, Streptomyces davawensis JCM 4913
MRMRTSLTLTWNRAVASVTSEPATVTSATTGSSLALTFGDLSTTAGATQRVTVRLG

SEQ ID NO: 43665 - protein, 508 aa, Streptomyces davawensis JCM 4913
MRRPLSTLLAGTLLAALGFGLAPSPALATVTERAPAAGAQVAAYAQWQPNTSYTVGTRVSYGGKDYECLQSHTSLTGWEPSNTPALWKLLGDSSGGTDTTAPSAPASLRSTGTTSSSVSLAWNAAGDNVGVTGYVVYRDGAQVATTAGTSHTVGSLSASTAYTFTVRARDAAGNISPASNAVTATTQSDGGTPPGTTPAAINGRLKVCGVKLCNQYGKPIQLRGMSSHGLQWYSHCLTNGSLDALATDWNSDVLRISLYVQEGGYETNPRMFTDRVHQLIEMATARGMYALVDWHQLTPGDPNYNLSRAKTFFTEIAQRHRGKTNLLYDIANEPNGVSWSRIKSYAEQLIPVIRAQDPTTPILIGTHGWGSLGISDGRNETDIINNPVQATNIMYTFHFYAASHDQEYLDALNRASDRIPIFVTEFGTQEASGDGPNNFTRTQQYLDLMANKKISWVNWNFSDDERSGAVFKPGTCNNNGPWTGTTSLKPAGVWIRDRIRTPDSFPTT

SEQ ID NO: 43666 - protein, 768 aa, Streptomyces davawensis JCM 4913
MRMNRRALFLAAALSLTAAGAGRSEGAYDSYDALRHRWLELALGTGYDPTAEPYASRLAETGTLARGFRNTMAPAATSLWPGHPYDPPAGITQSYSRLWTMTQAYLKTGTGSTGDPELLADILRGLDHLSATVYNPSTTRYGNWWEWQIGSPRLLMDIALALHDHLTDDRRAAACAAVDHFVPDSALADYSGTSTGANRVDLCRSVALRGILGREPAKIALARDALSPVFPYVTKGDGLYADGSFVQHTRVAYSGTYGQVLLDGLGRLFALLAGSPWEVTDPNRQLVLDSVEHAFAPLIHDGLIMDGVNGRAISRGHLKSDERQILRGDHFHGHGVIAAFALLAGGASPAERERWYGRIKGWIERDTVSPVLTARQFPVADLARLHSIADSAVPAAPEPVGHHLFAAMDRAVHRRPGFVASIAMASDRVAHYECGNGENPRGWHTGAGMLSWWVPGQGGQYTDWFWPTVDWYRLPGTTVSTRRLPDRAGGEWGEPRPDARWVGGVTDGEYAAVGQHLKGLGSNLQARKSWFCVADAVICLGAGITCADGVPVETVVDNRNLGENGDAAFVRGDGWAHLEGHGGWLVPDGRLRTLREDRTGAWSDINTGGTTERRTRRWQTLWLDHGADPEDADYLYVLMPGAPRRTVAARAADRHWLSVLANDTGCQAVRVPSLGLTAANFWRAGSAGPLTASTAASVLVRRDGRTATLSVGEPPRTGAPLEITWDRPVRSVVRADDTVEVLATGRRLRVRVTPGRACASHECEVALS

SEQ ID NO: 43667 - protein, 546 aa, Streptomyces davawensis JCM 4913
MRRNTMLWQAITATVLTGGLVVGYVGLTPASAAGSNLALGKPVTASSVEGAGFEPAKAVDGSTSTRWASLEGVDNQWIQIDLGSVTDVAQVVLKWEAAYAKSYRVEVSDDGSTWRQVYSTTTGNGATDDLAVSGSGRYLRVYGTQRATAYGYSLYEVEVYGDSPTSPDPTTPPDSTTNLLAGRPTSVSSVEGTGFEGGKAVDGSTSTRWASVEGVDPQWLRVDMGSTKTVGRVVLKWEAAYAKSYRVEVSDDGSTWRQVYSTTTGDGGTDDLAVSGSGRYLRVYGTQRATAYGYSLYEVEAYGTGSTTPPPSDTANLDDPAKKEIAMKLVSSFENSSLDWRAQFAYIEDIGDGRGYTAGIIGFCSGTGDMLDLVERYTQKKPSNPLAPYLPALREVNGTDSHAGLGTSFENAWRTAAQDSVFTKTQEEERDRVYFNPAVGQAKTDGLKALGQFAYYDAAVMHGEEGFRAIRSRAVSRVKPPSQGGNEVTFLHAFLDEREEEMRKEEAHSDTTRVSTAQRRFLNEGNLHLNIPLYWSVYGESFSITS

SEQ ID NO: 43668 - protein, 509 aa, Streptomyces davawensis JCM 4913
MKYRRRLAALAAALGLGLLGLSVPSTPAEAAPTWTLRWAPDPTVQGLGAFETLEDDRADSHTSFGPHIKVAGDAYRFDMHMVDRDTSTDRQRHEVTGNRTSSSSYLNWNLGETWRVTYSMYIPSSLMATTTFTHIMQTKQPGPGTSPITVTSLRRVNGVQTIEHKVIDGDVLVGRTNLEPLQNKWIDIEYEMKIGDGTAGSVRWVVKSAGTTIVDATKTGVDTFLADRVRPKWGIYRSLGDTSGSLRDTYLLLRNMRAYELTAGTPGDTQAPTVPDGLRSTGTTASSVSLAWNASSDDTGVTGYDVYRDGTKVSTVTGTSTTVSGLSASTSYSFTVRARDAAGNVSAASNTLPVTTSADSGGTDTQAPSAPSGLYSPSKTSSSVSLAWNASSDNVGVTGYDVYRGTTKVSTVTGTSATVSGLSASTAYSFTVKARDAAGNVSASSNSVSVTTDAAGGGTCPTAWSSTQSYVPGDVVSYAGHKYTATYYSTGAVPNDPTSWAVWRDDGAC

SEQ ID NO: 43669 - protein, 291 aa, Streptomyces davawensis JCM 4913
MSVRRTSLGRFRSAACVLSLVVGAVLGLSGTGSAVGPVAGPARAASAVEALGIAGTAWGVDQRTGTLRVDVDSSVSAGDLARLRQVAERSDVRVVLQREEGRLRTLVSGGDGVFAAGLRCSAGVNVRSGTTYYFVTAGHCTDAASTWYTTSAQTTSIGPTTSSSFPGNDFGVVRYANAAVPHPGTIGTVDITGTATAYVGQSVCRRGSTTGVRCGVVTGLNATVNYGGGSIVYGLIRTNICAEPGDSGGPLYAGDKIIGILSGGSGNCTTGGTTYYQPIQEVLSSQGLSVY

SEQ ID NO: 43670 - protein, 296 aa, Streptomyces davawensis JCM 4913
MRLTPQHTLRWVTPAFGAMLLLVSGTGPASAVPIGESRTGKMTWYDDTGYGACGTQINAATEDLVAVSYAWWTTANPNADPLCNGISVQVTYNGRTITVPVKDKCPGCPAEHIDLSKSAFQKLAPLDVGVVNGITWKFVSTNGGGGGSDTQAPSAPSGLYSPSKTSSSVSLAWNASSDNIGVTGYDVYRDGTKVSTATGTGATVSGLSASTSYSFTVKARDAAGNISAASNSLPVTTSAGSGGGGTCPTAWSSTQSYVPGDVVSYAGHKYTATYYSTGAIPNDPSSWAVWRDDGTC

SEQ ID NO: 43671 - protein, 144 aa, Streptomyces davawensis JCM 4913
MRNTARWAATLGLTAAAVCGPFAAAAPAAPGPAPASLYAPSALVLTVAHGESSALAAPERAVTLVCAPAPSGTHPDPAAACAELRAAQGDFDALASADDMLCTREYDPVVVTVDGVWRGQRVSYERTYSNECVKSSLGASVFAF

SEQ ID NO: 43672 - protein, 268 aa, Streptomyces davawensis JCM 4913
MRHPTRRTLLAATVASTAAIPLLNAGHAGAVRAPGLDDPAKKEIAMKLVSSAENSSLDWKAQYKYIEDIGDGRGYTAGIIGFCSGTGDMLDLVELYTDRSPGNVLAKYLPALRAVDGTDSHAGLDPDYPRDWRRAAQDRAFQQAQNDERDRVYFDPAVRQGKADGLRALGQFAYYDAIVMHGGGSDRLSFGSIRRRALQSARPPAQGGDEVRYLHAFLDARVWAMKQEEAHSDTSRVDTAQRVFLRQGNLDLNPPLDWKVYGDSYHIG

SEQ ID NO: 43673 - protein, 766 aa, Streptomyces davawensis JCM 4913
MLETAVMTTRWSRRGFLTASTASALTFTLPTPVGVAAEERAAEDADEFATLRAKWRTLILGEGFSPTAEPFKSRLAELGSTAGQLRSTMAPAAGSLWPDLVYADPEPDTDQESYGYSGNLNSSYNRLNTLAQAYIQPGTGLTGDSTLRTAVLTGLDHLHSEVYNENQTRYGNWYSWQIGAPQALLDVCVLMYDSLTAAQISDYCAAVDHFVPDSAVADYTGTSTGANRVDLCRVLALRGIVGGSSAKVALARDALSPVFPYVSSGDGLYTDGSFIQHSTVPYTGSYGSVLLGGLGMLFALLNGSTWAITGPKRQIVFDAVENAWAPFLYNGLVMDGVSGRAISRGLSASDSKQIQQDDHLRGHPILASIVLLGQGASTTESARWRGLVKGWVQRDYYSPPMSNPAIGLPHLARLKSLLDDTTITSIAEPTGHRLFTNMARATHRRPGWAASLSMADRRITYYETGNGENLRGWHTGSGLLYWWGDTFGNGQYSDAFWPTVDPCRLPGTTASRKVLADAAGGDWGASLPDVNWVGGTTDGQRAAIGQYLKGLQSTLLAKKSWFFLDDTVVCLGAGIRCTDGTAVETTVENRNLGPTGNSPFTVDGTTKPLAYPWSETLTGARWAHIGGHGGYVFPGGASVKALRETREGRWSDINKGGSTTALNRKYLTMYVDHGTDPTAGTYAYLLMPGATAAQTQARAAATGWVSVLANTDDQQGVTVPSLGFTGVNFWFGGTVGDLVASAPCSVMINERADGTAVICVSEPLSS

SEQ ID NO: 43674 - protein, 429 aa, Streptomyces davawensis JCM 4913
MPKRKAAIAAGGVAALGAAAILLPNANASQDGASDDAAAPRTLKAADASDLASQLEGLLGDAFAGSYYDADDQQLVVNVIPGDNNNVIVQAKKAGAKVREVENSLAALDAGAQTLKSEATIPGTSWAVDPRTNKILVTADSTVTGAKWDQLESTVDSLGSGMATIKKSEGTFKTFLSGGDAIFAGGARCSAGFNVTAGDGSPAFLTAGHCGVAAAEWSDAEGGAPIATVDAATATFPGAGDFALVKYDDPATEAPSEVNLGDQTVAISQAAEAEVGLQVFRMGSTTGLNDGQVLGLNATVNYPEGTVTGLIQTDVCAEPGDSGGSLFTQDGLAIGLTSGGSGDCTVGGETFFQPVTTALEATGATLGAGDAAGDAGAGAGEEAGAGDAGAGQDAGAGEEAGAGEEAGLGEEVGVGEEAGADDSGLTEQH

SEQ ID NO: 43675 - protein, 460 aa, Streptomyces davawensis JCM 4913
MRHARRRIVRRVTRLAAVGGLLLGSAMVTRAVASEPSDTAPGASVRSAVDTGAGLVERLGTARTAGSWIGADGRPVVAVTDEQAAAEVRRAGAQPKLVSHSMNELKSAASTLRSAPRVTGTAWAMDYRTNEVVVRGDSTVSGADWSQLTDVAGGIGSFVRMERTDGTFTTRLNGALPILSTAGRCSAGFNVTDGQRDFILTAGHCGPNGSVWFADTQGREQVGSTVRGSFPGGDFSLVQYASGDAGDGADVVAIGDGRGVRITGASDPSVGQRVFRSGSTSGLRDGTVTALNATVNYPEGTVTGLIETNVCAEPGDSGGPLFSEGVALGVTSGGSGDCQAGGTTFFQPVTKAMAEVGVQLITAAGQGGGQGGGQQSAAPEPSASATQSAIAPGAASPGSSAPVGGGDEGAQLLSRLADPRNVGPGLLIIAGSLVALVATRFIRAEQDRKAYQRYYSATWG

SEQ ID NO: 43676 - protein, 427 aa, Streptomyces davawensis JCM 4913
MTAISRVVAREIIDSRGNPTVEVDVELKDGSLGRAAVPSGASTGAREAVELRDGDPTRYHGKGVRRAVDAVNETIADAVIGLDAEDQATVDRTMIELDGSDTKSQLGANALLGVSLATAKAAAAAHRLPLYRYVGGVDARLLPVPMMNIVNGGAHADNPLDFQEFMIAPIGAASFAEAVRMGSEVFHTLRSNLVAAGHSVNVGDEGGFAPDLRTADEALDFVVRAIEQTGYKPGTDITLVMDPATSEFFRDGVYDYAGEGVRRTPAEHADYLATLVDRYPVASIEDPMAEDDHEGWRDLTTRLGERCQLTGDDVFCTNETLLSAGIRDGIANSILVKVNQIGTLTETLATVATAHRAGYTVVMSHRSGETEDTTIADLAVATGCGQIKTGSLSRSDRTAKYNQLVRIEEQLGAQARYAGREALGLRR

SEQ ID NO: 43677 - protein, 137 aa, Streptomyces davawensis JCM 4913
MTTSTQAGEPLITRSGNSSVANIRLQQGSNADFRYYEGNDSRGSYASTDGHGRGYIFLDYRQNQQYDSTRVTAHETGHVLGLPDHYSGPCSELMSGGGPGTSCRNANPDANERARVNQLWANGLAAAMDKALEKSGR

SEQ ID NO: 43678 - protein, 383 aa, Streptomyces davawensis JCM 4913
MAVRGRHRRYQPKRINRASLTVTAGGAGMAIPLIGTGTAQAADVETWDKVAACESTNDWNINTGNGYYGGLQFAQSTWEAYGGTRYAPRADLATKDQQIAIAEKVLDGQGPGAWPVCSVQAGLTRGGDTPELKTSVPDVRPQTTPQSRAGKAEMYTVVRGDTLSTIADEQDVRGGWQRLYDANRQTVGADPDLILPGQRLALGGKSATKTTSTAAKSKQERATSEKKSPPEKRSTPEKKKPEKQSSNKTRTMVSPVSAPTGTPYHKAGSSWSQGYHTGVDFPVATGTSVLSVAQGTVVNAGWEGSFGYEVVIRHADGRYSQYAHLSAISVKSGQQVGAGQRIGRSGSTGNSTGPHLHFEVRTGPGFGSDIDPVAYLRAGGVRI

SEQ ID NO: 43679 - protein, 451 aa, Streptomyces davawensis JCM 4913
MSSNSQYETYEAPPAYGGLDAPPGDLHSAETLAYGVGAYGQVYADTYQPAYEGDDWRAPDEGALAPVVHAGVGRRGARRRKTRYAGSADGSMRRLLPQALVVAFLAGGTSAFVAKDKAIELSVDGRPRTLHTFADDVSELLAQEGVELGAHDVVAPAPGTELSSGDEIEVRYGRPVRLTLDGVRHEVWTTARTVDEALEEWGVRAEGAYLSAARSLRIGRAGLALDVRTERSVTVMADGRARTVRTNAASVGEVVEEAGITLRGQDTTSVPLGSFPRDGQTVTVLRITGTKEVREEEIPFDVRRTEDPALFRGTEVVERAGQPGLRRATYSLRTVNGVRQKPRRIRTEIVREPRTQLVKVGTRPMPASVRGADGLNWQGLAACESGGRANAVDPSGTYGGLYQFDTRTWRSLGGSGRPQDAPAAEQTLRAKKLYVQRGASPWPHCGARLHG

SEQ ID NO: 43680 - protein, 228 aa, Streptomyces davawensis JCM 4913
MSYRNRTAALASVAALAGSAVLMAAPAARAEVVDVNYQCKTPIGDKSAVSPIDIKGVASGGGYKITMSWQKGVSSSPVELGKGAMNPSATIKLGGAESGTLSVSGPANQEAIPANTPIKINDLTGTYTPKKSGKVTFTPGVLTIKALGTTTTCTPSNSPGPALTLDVKAAGGGGGGGTPQSGSDSGSELPQTGPEDSAVALGTLGGTVLLAGAAGALWLTRRNQMARR

SEQ ID NO: 43681 - protein, 654 aa, Streptomyces davawensis JCM 4913
MPLPVPVLPDGVDPAWLPPAAFEAIGRRRTLIRGSGLLVDTVHGEVAEACARFGGSVVRDASPEPCDLVLDVSGTDDGEAFTLKRAEGRTTVTASGRHGLLHGLFHLVRLGEEAFRGERAAHTHRPAVALRVLDHWDNVAVHPVMGQVERGYSGGSLFWRDGRARGDLERVRVYARLLAACGINAVTVNNVNVHATEARLLTERIGDVARIAEAFRPYGIRTHLSVSFAAPILLGGLDTADPLDHGVRRWWERATAEVYAAIPDFGGYLVKADSEGQPGPFAYGRSHADGANLLAAALAPYGGTVRWRAFVYDHRQDWRDRSTDRARAAYDHFVPLDGEFAANAVLQVKHGPMDFQVREPVSPLLGAMPGTRLAVEMQATQEYTGQQRHACWLGPMWSEALRFRPEGTDPVGGLSDGLVAVSNAGADPFWTGHPLAQSNLYTFGRLAWDPGADPLAILDDWIGLTFGPDPAEGVRAVLAGSWRTYEKYTAPLGVGFMVQPGHHYGPSVDGYEYSPWGTYHFADRDGIGVDRSVATGTGYAGQYAKPWAEVYESPASCPDELLLFFHHVPYGHVLHSGKTVIQHIYDTHFEGVEEVEEAREVWGSLGQSVDPERHARVTERFAEQLRCAREWRDQINSYFLRKSGVPDERGRALY

SEQ ID NO: 43682 - protein, 450 aa, Streptomyces davawensis JCM 4913
MLQRLPRPTRAACTGAVAAGALFVAGLSGSANAGTEPAAPTAAQTLRTAEGPPALIHAMARDLGIDARQARDRLANEAEAGADAGRLRAALGADFAGAWVRGAASSALTVATTDDADVPAIEARGATAAVVRHSLADLDAAKARLDRTATDRAGTDTPVWYVDVPTNTLVVEAVRPAAAHALLKAAKVDSGLARIVRTSEQPRPLYDLRGGDAYYIGSGSRCSIGFPVTRGTQNGFATAGHCGRAGATTTGSNRVAQGTFQASVFPGNDMAWVAVNSNWTATPNVVGSGVQVAGSTQAMVGASVCRSGSTTGWHCGTVQQLNTSVQYQEGTVSGVTRTSVCAEPGDSGGSFISGSQAQGVTSGGSGNCTSGGTTYFQPINPILQSYGLTLKTTSSGPGDPGDPGGTWAAGTVYQAGDTVTYGGATYRCLQGHQAQTGWEPPNVPALWQRQ

SEQ ID NO: 43683 - protein, 360 aa, Streptomyces davawensis JCM 4913
MKHRRIPKRRAAAVGAGIAALVAAGVTFQTANASEPTAAATPETLSVKAAGKLASTLVQDLGNAAAGTYYDAQSKNLVVNVLDKDAAETVEEAGAKARVVANSLAELKSARGTLKQDATIPGTSWVTDPTTNRIVVTADRTVSDAEWAKLGEVVDGLGGTAELQRTKGEFKPFIAGGDAILGGSGRCSLGFNVVKGGEPFFLTAGHCTEGITDWQDSSGNELGSNEVSSFPDNDYGLVKYTAEVEHPSEVNLYNGSTQAISGAADATVGMEVTRSGSTTQVHSGKVTGLDATVNYGNGDIVNGLIQTDVCAEPGDSGGSLFSGDKAVGLTSGGSGDCTSGGETFFQPVTEALSATGTEIG

SEQ ID NO: 43684 - protein, 271 aa, Streptomyces davawensis JCM 4913
MDSETNPPHSPLVSRKTVLRAALAAGAAVPLAMAGGPALARTFADTGTPVQVTPPCDDGDDPTPDQIEGPYFKPNSPQRTDIAGPGVPGTRLMVTGYVFGLACRPIAGALLDFWQADHNGAYDNTGYRFRGHQFTASNGSFALTTIVPGLYPGRTRHIHVKVQAPGRPVLTTQLYFPNEPRNSTDSLFDPRLLMAVRDGGGGRQASFDFVLNVPQDPDDPGDPGDTTWSVGTTYQSGARVTYAGRGYLCLQAHTAQTGWEPPNVPALWQAA

SEQ ID NO: 43685 - protein, 379 aa, Streptomyces davawensis JCM 4913
MKRTVALRAAVAALLLATGLGTAQASAAPPTPRAEASVSPGMLDAMRRDLGLTEAQATERLRAEAAAVDTEKAARAAAGRAYGGSWFEASTGRLVVALTDRAKVDDVRELGADTRLVKHSAAALDRAKARLDSLSAPTGVAGWHVDAEANSVVVTVVRGERNAAGVRDFVDRALDQGPVTVVQTSEAPRTYAAGTVGGDPYYTGNVRCSIGFSVHGGFVTAGHCGQPGWAVRGWDGSAMGTFQGSSFPGNDYAYVSIHSGWWTVPVVLGWGTIPDRLVRGSAEAPVGTSICRSGSTTHWRCGTVLAKNETVNYSQGAVYQMTKTSVCAEGGDSGGSFISGDQAQGVTSGGWGNCSSGGETWFQPVNEILSRYGLTLHTA

SEQ ID NO: 43686 - protein, 257 aa, Streptomyces davawensis JCM 4913
MTSRRTGRRALIGGLASLGVTVGMITTGPFPAAHAATWPTPTSSRPVSATIPVSGTVDGGMKRYYGSGDLAGDGQEEGQDPIFKLAAGATLKNVIIGAPGADGIHCEGNCTLQNVWWEDVGEDAATFRGGSTYTVTGGGAKKAADKVFQHNGPGTVNISNFAVSEFKTLYRSCGDCSTQYTRRVNLSNIEVTGTGSTARLVGINVNRGDVATLRGITILNDAGRKVIPCQRYNNTTAVGTGPDSTNCLYSSSDITYR

SEQ ID NO: 43687 - protein, 323 aa, Streptomyces davawensis JCM 4913
MLSGNGRHRRPRQAPALIVAAGVTGSAIAIPLLGASGASAAEGTAWDRVAECESGGYWSEDSGNGYYGGLQVTQENWERYGGTTYAESADQASRSQQIAVAERILADQGLAAWPTCGPLSGLDEESGSVDLDTGVAGDESASSGDSGSSGLLDSIDGDEDSDEQGNSPSEESDNSTKSDKSSKSPESEESEDPRESAESSQSSGSSESPDGDPSQEVDSKPTATPGRDNSDNIGQNDGDSALTDTGANGTGRHRGEPADEGVTDGSYVVRDGDSLTGIADSLDLNGGWRGLYAANKSTVGTDPDLILPGQTLEVGVEPGEKQR

SEQ ID NO: 43688 - protein, 426 aa, Streptomyces davawensis JCM 4913
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLILEAIKEAGYTPGEQIALALDVAASEFYKDGVYTFEGKERSAAEMTEYYAELVEAYPLVSIEDPLFEDDWAGWKIITDKLGDKVQIVGDDLFVTNPERLARGIEEGTANALLVKVNQIGSLTETLDAVEMAQRNGFKCMMSHRSGETEDVTIADLAVAVNCGQIKTGAPARSDRVAKYNQLLRIEEILDDAAVYAGRSAFPRFKG

SEQ ID NO: 43689 - protein, 229 aa, Streptomyces davawensis JCM 4913
MLFSGKGKHRRPSKATRAIAIAGVTGVAVAAPLMAVGSASAATASEWDAVAQCESGGNWSINTGNGYYGGLQFSASTWAAYGGTQYAATADQASKSQQIEIAEKVLAGQGKGAWPSCGVGLSSATYTGGSTETSTQPSTETRTTEEQPASRSTERPAQKADKAKKTVTTPTGKKVKKGDGEYKVVKGDTLSTIAEEHDVKGGWEKLFKLNKDIVEDADLIYPGQQLHLK

SEQ ID NO: 43690 - protein, 241 aa, Streptomyces davawensis JCM 4913
MSSRRTTTIAGSLVAASFSAVMILPFTAAADDEGPQSSKGGKAVDEAPAGVELTTTLPEKISVDNKSEETAITATVKNEGTKESGEIRLLVVGFDGLTVNNVQGCSEIAEGDLPEGSNSGFACAVDNLAAGDSKSYDVEATYDLSKTGKICLPVQTASGDKTYWQQGPVPFGTTNPSPNAPATPLLLGTDNQPVAPGGDELPKTGVERDVLPLGAAGAALIAAGAAGLWWSQFRRPVRQER

SEQ ID NO: 43691 - protein, 350 aa, Streptomyces davawensis JCM 4913
MAHHCRPLGSGVPLHIGGSFTVLRSLPMTQTRAASLITVLTALLAVLLAPAPASAASLQEVTGFGSNPGALRMYRYVPDGLPAGRPVVVAAHGCTQNASGYATGTGWLQLADRWGFSVVLPQQQSANNLSGCFNWFQTGDIQRGQGEAASIAQMVDRQLADTGGDASRVYVTGLSAGGAMTSVMMAAYPEKFRAGGVVAGLPYGCAQAAGSPYVCMYVGATQTPDQWGDRVRAARPGYGGPWPTLTVLQGSADYTVKPVNMTDLVEQWTDVHGTDQAADVSDTVAGYPHQVFRGPAGNSVVETYSLTGMGHGQPVDPGTGSAQCGAVGAYFLDVNLCAAHRLALAWGLDG

SEQ ID NO: 43692 - protein, 197 aa, Streptomyces davawensis JCM 4913
MYRTPITLAVTATLLALAPGGAHAAPPPPAPASGTPSTRAPYACAKDQWPWGCIAECESSGRWHINTGNGFYGGLQFWQPTWKEFGGLKYAARADLATRAEQILVAQEVLAVQGWGAWPVCSKRYGLKGRMHTVKSGDTLSAIARKYKVKGGWPAFHKANKKTIGADPNRLKPGMLLVIPKASTRSSALFGPPVTSA

SEQ ID NO: 43693 - protein, 283 aa, Streptomyces davawensis JCM 4913
MRTKRTRLLAVAAGLVAATLAGAPGAAAGDTAPRSAAQLAQVQDAVADAAVDGTAWYVDETSGRVVVTADSTVSKAETARIKKAAGADAGAVRIDRAQGVFRPLLSAGDAIYGGQYRCSLGFNVVSGSTYYFLTAGHCGKSVSTWYTDQAHNTLIGPTLGASFPGNDYALVRYDNTGLSHPGGYSAADAYVGESVKRTGSTTGTHSGTVTALDVTVRYQGGGTVRGMIQTTVCAEPGDSGGPLYDGTKALGITSGGSGNCRTGGTTFYQPVPEALSAYRVSVY

SEQ ID NO: 43694 - protein, 276 aa, Streptomyces davawensis JCM 4913
MTAPAEQHVRHRRKVSKRRAVIAGASALGITGAAIVTTTMLSSAGAASTWPTAKGSQAVSSTIKVSGTYDGGYKKFYGSGALGGDSQDEGQDPVFQLADGAVLKNVIIGTPAADGVHCMGSCTLQNVWWLDVGEDAATFKGKSTSSVYTVYGGGAKNGSDKVLQFNGAGKLVVSKFQVADSGKLVRTCGNCSTQYKRTVIINDVDVTAPMNSIAGINANYGDTASLRKVRIHGDSAKKIKTCVRFKGNNTGAEPTQIGVGPDGTSCRFTASDITYQ

SEQ ID NO: 43695 - protein, 207 aa, Streptomyces davawensis JCM 4913
MSECADTTRDNARRTRTTAVLAGAALLAPLGLLAATGNAAAADGGVWDRIAQCESGGNWHINTGNGYYGGLQFSASTWSAYGGGAYAATADRASKDQQIAVATKVQRAQGWGAWPTCSARAGAYGSAPAAGTATTKATPPKAPQAPERSSGHTDRGSSRGDYVVRQGDTLSGIAARYGTTWQRLHAANKAVIGADPDVIVPGQRLDI

SEQ ID NO: 43696 - protein, 301 aa, Streptomyces davawensis JCM 4913
MRRTGILAFALAPVVLTAGAYFLMPTDSAESPAAPPVSAAQLAREEAKERAETERAEDEKTIASLPPGLADPAKKELALKITATAEFSSLNWRLGYGSVEDNGDGCGYTAGAIGFCTGTHDLLDLVERYTETHPDNGLARYLPALRKVDGTDSHEGLDPGFPAAWKAEAKKPAFRAAQDEERDEVYFNPAVRLAKLDGLGTLGQFVYYDAMVLHGPDPSANGFYGLRERALHEARLPSRGGSEKAYLDIFLDLREQAMKRKKSTADTSRVSTAQREWLYDGNLSLNTPLSWRMYGEPYQVS

SEQ ID NO: 43697 - protein, 779 aa, Streptomyces davawensis JCM 4913
MLSPNRARTSLLAGAAAIAGLLLAGLPATVSHAADQESCRPDGLYKTPGVDVPYCSVYDAEGREKMGADHQRRVIGYFTGWRTGKDGTPAYLAPDIPWDKVTHLNYAFAHIDGSNKISVGADSATNAATGMTWPGVNGAEMDPGFSYKGHFNLLNKFKKQHPNVKTLISVGGWAETGGYFDDSGTRVNSGGFYSMATNADGSVNQAGIDIFANSAVDFIRKYGFNGVDIDYEYPTTMKDAGNPLDWSISNARRAGLVKGYAVLMKTLREKLDRAGAADGKHYLLSVAAPSSGYLLRGMETFQVQKYLDYVNIMSYDLHGAWNEYVGPNASLFDDGKDAELAAAGVYSASQYGGIGYLNTDWAYHYFRGSMPAGRINIGLPYYTRGFKNVIGGTDGLWGKAATTNCPAGSGLTKCGDGATGIDNLWHDLDTNGKESPAGSNPMWHAKNLEKGVVGDYVTKYGFPADTRLTGSYARKYDSTLVAPWLWNAEKKVFLSTEDEQSVNAKADYVVANGIGGTMVWELAGDYGWNATKGQYEPGSTLTTAMYEKFKSASPYGATVSNKALPTQAVDIGVEFGEFKLGDSNYPITPKVKITNNTKSALPGGTEFQFDYSTAAPANASDQSGFGAKVISSDHTGSNVGGLKGDFHRVSLKLPSWQSLAPGASVELSFNYYLPVSTPWNWTVNISGTTYSLAGNLGRGTTLVEPGSGGTPTPDPTDPTPTPTPTPGACTAPAWNSTTEYGGGTQVSHKGHSWKAKWWTKGEEPGTTGEWGVWQDLGAC

SEQ ID NO: 43698 - protein, 302 aa, Streptomyces davawensis JCM 4913
MRIKRTTPRSGIARRTRLIAVSTGLVAAAAIAIPSANAADTPTTFSSTELKSASSSVLKADVPGTAWAVDSKTNRVVVTVDSTVSKAEIAKIRQQAGGNADALTIKHTSGKFQKYIAGGDAIYASSWRCSLGFNVRNSAGAYYFLTAGHCTDGAGTWYSNSGRTTVLGPTAGSSFPTNDYGLVRYTNTSITKSGTAGNTDITRAGTPSVGTTVTRDGSTTGIHSGRVTALNATVNYGGGDVVYGMIQTTVCAEPGDSGGPLYSTSGIAYGLTSGGSGNCSSGGTTFFQPVVEALNAYGMSVF

SEQ ID NO: 43699 - protein, 434 aa, Streptomyces davawensis JCM 4913
MPTPTTRCAVLLTALLSLLAALLVTAPASSAARADATDVVPAATLTEVTDFGANPSNLQMYLYVPDSVTDHPAILVAVHYCTGSGPAMYSGTEYASLADRYGFVVIYPSVTRSSKCFDVSSPQALTRGGGSDPVGIKSMVDWVTAAYDADTARIYATGISSGAMMTNVLLGVYPDVFKAGAAFAGVPFGCFATTDGSEWNSACANGTVTRTPQAWGDLVRTAYPGYTGPRPRMQLWHGTQDDVLRYPNFGEEIKQWTNVQGLGQTPAATDSPQSGWTRTRYGGTGDQAPVEAISLQGVGHNVYSYGVMGPLVIAFFGLDDDGPTPQPPAGPCKVSVTTNAWNTGLTASVTITNTGTTTVNGWQLGFTLPTGQTITSGWNATYTPASGAVTATNASYNGTLAPNASVSIGYQATHTGNSAAAGAYTLNGIACTVG

SEQ ID NO: 43700 - protein, 297 aa, Streptomyces davawensis JCM 4913
MRAEGGVAKVVKHSTATLNSVRATLDRRIADVDPIPNTSWGVDPSTNTVTVDVFDAVSAADEKRLTRLVARYGDAVRVNRLPGKVDTAAYETLGGIGIESTDVAAGRYSACTLGFNVRDASGQKYFVTAGHCADSSSFQWWDRQAGGIYLGKRIWYDYGAIEKDYAVMEYRGENLAAYGAVRAAGVEYEITDSRYPNDGESVKRAGAVSSDLVGAVLSPSETVTFTDGTVLKNMIKTSNCGLQGDSGGPLWAGTDALGIFSGGNTPAGEPCNSAQSQYRSFYQPVHWVLAHHGLHAF

SEQ ID NO: 43701 - protein, 438 aa, Streptomyces exfoliatus
  Streptomyces hydrogenans
MSLSVSRRLAAVTAFAVAGLFASAVPAALAAPSAVAAAPTPPDIPLANVKAHLSQLSTIAANNGGNRAHGRAGYKASIDYVKGKLDAAGFTTTLQTFTSSGATGYNLIADWPGGDPNSVLMAGSHLDSVTSGAGINDNGSGSAAVLETALAVSRAGLQPTKHLRFGWWGAEELGLIGSKYYVNNLPAAEKAKISGYLNFDMIGSPNPGYFVYDDDPTIEQTFKNYYAGLGVPTEIETEGDGRSDHAPFKNAGIPVGGLFSGADYTKTAAQAQKWGGTSGQAFDRCYHSSCDSLTNINDTALDRNSDAVAYAIWTLGAGTPVPPGQSFENTADVNVPDSPAAAVSSPITVSGVTGNAPATTKVDVNIVHTYRGDLVVDLVAPDGTVYNLHNRSGGSADNLVQTYTVNASSEVANGVWNLRVKDTAAQDVGYINSWKITF

SEQ ID NO: 43702 - protein, 1090 aa, Streptomyces exfoliatus
  Streptomyces hydrogenans
MAAMALTASLAGALAGTASAAQQAQPSPSQKDTPAARAVAAADQAVDSGLDSLVNSSQEQYERRLVTPWVKDLYSVSYERSYRGLPVVGGDAVVLADGTGKVRALQSASSVRIDVSTQASVSAKDAESTSRAKLVSVDKVESSRLVVRLKDDKPVLAWETVLSGRTKTAPSKLHVFVDARTGAFVDSYDEVVAGTGNSKWNGPGPVTIDTTNSGSTYTLRDPVRTGLSCADYSTGTVFSKSSDSWGTGNPTSKETGCVDLMFAAQKQWDMLSQWLGRNGVSGNGRSFPAKVGLSDLNAYWDGSSVTIGRNSAGEWIAGIDVVAHEYGHAIDSNTPGGTSGQESGLGEATGDIFGALTEAFANEPAPYDTPDYTVGEVINLQGRGPIRNMYNPPAVNNDPACYSSAIPGTEVHAAAGPLNHWFYLLAEGTSPGGGKPNSSTCNGTSLTGVGVQNAGKIFYGGMLLKTSSMSYKKYRTATLSSAKSLDATCDLFNKTKAAWDGISVPAQTADPTCTPSGQNNDFSMSLSPSSGTVQQGASVTTTVGTTVTTGNAQSVTLTASGLPAGVSASFNPATVQSGQSSVLTLTATANAAPGASTIVVKGQGASLSHTVDYALNVGGTQPGNDPPDIDVANVQAHLTQFNTIASQNGGHRRAGSAGYTQSLAYVKGKLQAAGYTVTEQNCTSCTYPSNNLIADWPGGPADQTVMFGAHLDGVSAGPGINDNGSGSATLLENALVLAQKNPTMTKHVRFAWWTDEEQGLNGSEFYVNQLSSAQRSAIKGYYNFDMVGSTNGGYFINNVNSTTAAPLKAYWTSLNLAPEENTEGQGRSDDYSFQQAGIPTSGYAAGASARKTSAQATKWGGTANAAYDPCYHSSCDTTNNINATVLNRSADGVAYAVWKQAVGGETPAQDFSVAVSPSAGSAAPGGSTSATVNTATVSGAAQTVALSVSGAPAGVTATLSPTSVQSGSSSALSVQVGASTAPGTYTLTVTGSGTVSHTSTYSLTVTGGGSCTPRQLVTNGGFESGSSPWSATAGQTLETLSNLNANSGYAEKSYDLSQFAGQTVTLKFTGTEDQSLQTSFVVDDVTVQVS

SEQ ID NO: 43703 - protein, 304 aa, Streptomyces flavogriseus
  strain ATCC 33331 / DSM 40990 / IAF-45CD
MTFKRFAPLGSISRRARLIAATSGLVTAVALAAPTAVAQAAPDTVTKAELAVASSAVGTADIAGTAWYTEASTGKVVVTVDSTVTAAEIATIKKSVTDSGAKADIKRTPGTFNKLIAGGQAIYAGGGRCSLGFNVRSGSTYYALTAGHCTEIGSTWYTNSGQTTTLGTRAGSSFPTNDYGLIRHSNASAADGRVYLYNGSYQDITSAANPSVGQAVKRSGSTTGVHSGTVTGLNATVNYGGGDVVYGMIQTNVCAEPGDSGGSLFAGSTALGLTSGGSGNCSSGGTTFFQPVVEALNAYGVSVF

SEQ ID NO: 43704 - protein, 277 aa, Streptomyces flavogriseus
  strain ATCC 33331 / DSM 40990 / IAF-45CD
MKERAHTHRRRPGRRRMAAALTAALGLTGAALATNVMLQPAGAATAAVPAWPSATGSQAVSKTIEVSGTYDGSLKRFYGSGDLGGGGQDEGQDPIFKLADGATLKNVILGSPAADGVHCSGSCTIQNVWWEDVGEDAASFKGTSTGSVYTVYGGGAKKASDKVFQFNGAGKLVVTKFQVSDFGKLVRSCGNCSKQYKREIIVNDVDITAPGKSLVGINTNYGDTAALRSVRIHGDSSKKIKPCVRYTGNSTGAEPKETGSGPDGTYCRYTASDLSYD

SEQ ID NO: 43705 - protein, 272 aa, Streptomyces flavogriseus
  strain ATCC 33331 / DSM 40990 / IAF-45CD
MSQHTQPQQPYAPAQPPGSSPARNGLGISALVLGIIGTVSGLIPFFFWLAGILGLIALILGLAGRGRAKRGEATNKGVTTFGAVLGLVALILSVVGAVLTFKAVDEAVTDINKAVADSSASAKPATEGGAAAGGAAGGTEGKDDVLREGDSAAYDDGLEVTVNAPASYTADEFAIGHTKGNKAYTVSVVIENKGKEKYDATLVTVDARAGEDGVNAEQIFDGKVGEGFSGTVLPGKKITATYAFDAPADAKGLTVEVGPGLDWDASQWELKL

SEQ ID NO: 43706 - protein, 332 aa, Streptomyces flavogriseus
  strain ATCC 33331 / DSM 40990 / IAF-45CD
MGSATGRHRRPRQAPAIVVAAGVTGSAIAIPLLGAGGAQAADATTWDRVAECESGGMWSADLGNGYYGGLQFSQDTWNAYGGTEYASRADLASRSQQIAVAENVLDDKGPQAWPSCAVISGLALDGTLPGVDPGGEPSAEPSGTATETPSSDASDQAASKDDADAKSDAEPKGKAKDKGKAAGGTADTGDAAGSADASPSATPSSGTSGASGAAKGDAAKGDASTGGKHRGTPAPESSAGSALDEGRESGRHASRGDSEARQGAAEAYTVREGDNLWAIADAQELPGGWTALYEANKDELGSDPDLILPGQSLNLDAGADAQDAAAETAAAN

SEQ ID NO: 43707 - protein, 230 aa, Streptomyces flavogriseus
  strain ATCC 33331 / DSM 40990 / IAF-45CD
MLLSSKGKHRRPSKAVRIATLAGVTGAAVAVPLMGATGASAASVATWDAVAQCESGGNWSINTGNGYYGGLQFSQSSWAAAGGTQYAARADLATKAQQIAAAEKLLDLQGPGAWSCAGAGGLTNDGVDPGVDTGSAKNGDTDPQAAPERKAEQPTTRSEKRTAPEKTVTTPTGQKVEKGDGEYKVRAGDTLSKIADAEKVKGGWEKLFKLNDDIVDDANLIFPGQQLHLK

SEQ ID NO: 43708 - protein, 428 aa, Streptomyces flavogriseus
  strain ATCC 33331 / DSM 40990 / IAF-45CD
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATENKGSLGANAILGVSLAVAHAASEASDLPLFRYLGGPNAHLLPVPMMNILNGGSHADSNVDIQEFMIAPIGAESFSEALRWGAEIYHTLKKVLKTKGLSTGLGDEGGFAPNLESNRAALDLILEAVKEAGYVPGRDIALALDVAASEFYKDGVYEFEGKSRSAAEMTEYYEELVSAYPLVSIEDPLYEDDWAGWKVITDKLGSKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAVYAGRSAFPRFRFEG

SEQ ID NO: 43709 - protein, 437 aa, Streptomyces flavogriseus
  strain ATCC 33331 / DSM 40990 / IAF-45CD
MSAAAAAVGTVDRSIETVTARRIIDSRGNPTVEVDVVLADGSLGRAAVPSGASTGAREAVELRDGDTGRWHGQGVDRAVAHVNGEIAAAVRGRDGADQTGLDAALIALDGTTTKSRLGANAILGVSLAAAKAAAAAHRLPLHRHLGGGEADLLPLPMMNIVNGGAHADNPLDFQEFMIAPVGADTFAEAVRMGSEVFHTLRRDLRAAGHSTGVGDEGGFAPALRTAEEALDFVMTAIERTGYRPGTDIGLAMDPASSEFYRDGVYVYAGEGLRRTPSEQADYLAHLLDAYPVVSIEDPMAEDDLDGWRELTARVGDRCQLVGDDVFCTDATLLREGIRTGVGNAVLVKVNQIGTLTEALGAVSLAHEAGWTAVMSHRSGETEDTTIADLAVATGCGQIKTGSLSRSDRTAKYNQLIRIEEELGDSARFAGRSALRRA

SEQ ID NO: 43710 - protein, 300 aa, Streptomyces flavogriseus
  strain ATCC 33331 / DSM 40990 / IAF-45CD
MRIKRSTPRNGGITRRGRITAVAAGFVAVAALAVPAADADQSGTYSTSQLTAAGAAVLRADVAGTAWNADPATGRLLVTVDSTVSQAEINKIRKAAGADAGALRIERTPGTLSKLISGGDPVYASGWRCSLGFNVRSGTTYYFLTAGHCTEGADTWWADAAHTTVLGTTAGSSFPVDDYGIVRYTNATVAKPGTVGSQDITGAADATIGMSVTRRGSTTGLHSGTVTGLNATVNYGGGDIVYGMIRTNVCAEPGDSGGPLYSGTRAIGLTSGGSGNCTSGGTTFFQPVTEALNAYGVSVF

SEQ ID NO: 43711 - protein, 351 aa, Streptomyces flavogriseus
  strain ATCC 33331 / DSM 40990 / IAF-45CD
MTLAGSAVLALVAAGVTFQTANASDDVPQFSAKTLTAHSAGSLAETLDKSLGGDAAGSYYDAEAKNLVVNVVDEAAAEQVRQAGGKARLVQHTLAELTTARQTLTDKATIPGTSWAVDPVSNKVVVTADSTVDGAAWDKLGKVVEGLGSKAELKKTAGEFKPLIAGGDAIWGNGGRCSLGFNVVKGGEPYFLTAGHCTESITSWSDSQGGSEIGANEGSSFPDNDYGLVKYTSDVEHPSEVDLYDGSTQAITKAGDATVGMSVTRSGSTTQVHDGEVTALDATVNYGNGDIVNGLIQTTVCAEPGDSGGSLFSGDTAIGLTSGGSGDCSAGGETFFQPVPEALAAFGAEIG

SEQ ID NO: 43712 - protein, 421 aa, Streptomyces flavogriseus
  strain ATCC 33331 / DSM 40990 / IAF-45CD
MAATGRHRRYQPSRINRASLTVTAGGAGIALPLLTAASAGAATTDVWEKVAACESTGNWHINTGNGYYGGLQFTRSTWAAYGGTAYAARADLATKDQQIAVAEKVLDGQGPGAWPTCSVRAGLEQGGDAPDLAPQSKRQVAVDGGKGKAPESGPAARTARDGATVKASPTAVPGARESYTVARGDSLSGIASAERVRGGWQRLYAANRTVVGSDPDLIIPGQRLSLDGAGTPSTAAERKATPRSTAPEAAGKKAPKAAERARPATPKPAPEATEKTRRAAEKKASKPRSGFTAPVSAGTGTPYHQAGSWSSGYHTGVDFPVPTGTSVKAVASGKVVSAGWAGAYGYEVVVRHDDGRYSQYAHLSSLHVRAGQQVGTGQRIARSGSTGNSTGPHLHFEIRTGPGYGSDIDPLAYLRAGGVSV

SEQ ID NO: 43713 - protein, 377 aa, Streptomyces flavogriseus
  strain ATCC 33331 / DSM 40990 / IAF-45CD
MVRTGLSALLIIGTWATAGLTQATAADSRSSAEPQASAGIITAMQRDLGLTKSQAEARLTAEKKATALEGTARSAAGASYGGSWFDASSGRLTVAVTDDAKAGAVRAAGAQVRVVEHTARELDAVKNRLDALTAPSGVSSWHVDPRANSVVVTVVASEQGDNDVRSFVAKAREAGPVTVEQTSEAARTFAAGTVGGDPYYTGNVRCSIGFSVHGGFVTAGHCGQAGGAVRGWDGSAIGNFQGSSFPDNDYAWVNVGSGWWTVPVVLGWGTVSDQLVRGSNEAPIGASICRSGSTTHWHCGNVLAKNETVNYSQGAVRQMTKTSVCAEGGDSGGSFISGDQAQGVTSGGWGNCSSGGETWYQPINEILNRYGLTLHTA

SEQ ID NO: 43714 - protein, 858 aa, Streptomyces flavogriseus
  strain ATCC 33331 / DSM 40990 / IAF-45CD
MELSRRSALSAIPAATLWAVSQALRAEAAPPRDATTTANTPAPPAPSDTARLLRNTVAILAGTAESNARPEVAPKIDAVRATARARLAAMDRAGHDELFEGVPLGTSDPNLSTSYQYLYEIALAAGLPGTTTPDADATVRHRVVDGLARLHDDWFGEQSKGYYGNWFHWEIGIPGYATKTLILLRDDLAEQRPDLTAAYVASMDAYLRNGKDGDVDLDSRFHTGANLADITTNRILQGALLGDEARITKALADQLTVFATVDPYQPRHGVTDGFYADGSFVQHGSVAYTGSYGKGLLTRIVQTVKILDGTRYVPDDSLPGVVLGWIADGFAPLIFEGWMMEIVKGRAVSRTGTGYADVTAVVEAAVDLSAHTAGGDTETLHGYVKHIRQTSKAGLDPTAFVSPVSIARYADILDSPVPATDLCPAASHTAYNAMDRTVHRRPGYAFALARSSTRTSMYEYMSGENLMPWFQGTGAHHLYLSGTDQRQAYGVDHYTAVPPDRLAGVTAPAGTRRTVPELYGTLWYDNPGRGFTSSSEAQNAYVYFPRATQEFSGGTRLGTYGAAGLVLSDDAAYAAQQAGALPEDFVAYRAARATRSWFMFDDEILVLSAGVTGSAGRAATTTVDSRIADPASPVAVTGAVRDGSPWQRTGTAPPAWLRYADTGQRTSVGYVFLSGPPPVVALDTVTRSRRLVRLTNADTAVTKQVFTLSYEHSAGARPATTAHALVPNASPEQLASYAHGPLSVLSNTEQLQAAAHTHLGITAANAFTPGTHRVGRLVIDGPASVLLRRTEGGTYAVAVSDPTTARRTVSVTLHGRPLRTVSADPGVRVHHVPGGTRLDVTTHHAYGRSFTATLRGRA

SEQ ID NO: 43715 - protein, 212 aa, Streptomyces flavogriseus
  strain ATCC 33331 / DSM 40990 / IAF-45CD
MSAVAGLGLGLAAALGTTPAVAAAPSPASTAQAGYAAYAGSSENAKANKAFFDAVMKSVAEKRAANPGAAAVTVVYSTTNAPSFRSQIASSTSIWNSSVSNVKLQEGSNPDFTYREGNDSRGSYASTNGHGSGYIFLDYAQNRQYNSTRVTAHETGHVLGLPDHYTGPCSELMSGGGPGTSCTNAYPNSTERSRVNTLWQNGFAAALARATS

SEQ ID NO: 43716 - protein, 281 aa, Streptomyces flavogriseus
  strain ATCC 33331 / DSM 40990 / IAF-45CD
MPASPLAKRPVESVLALLLVLLSVLGLAGRSAADAPAQAPATIPAQAAPARAVVAPTVVAPTVTAGTDWDRIAQCESSGRWNTNTGNGYHGGLQFAPSTWRAYGGGQYAPRADLATRSEQIAVGERVARSQGMGAWPTCGRLGASGTSGSSSSSAGQSSSGNADRSEAAPSAPSRQSAGSSNDNASSGSGSGSTSSGGSASGRTDNGANGSSASGGSSVTHHSEDLVDEESYVVESGDCLSTIAERADVSGGWHALYERNREVLDQGPHLIFPGQRLSLHV

SEQ ID NO: 43717 - protein, 496 aa, Streptomyces flavogriseus
  strain ATCC 33331 / DSM 40990 / IAF-45CD
MRPPILRRLLRRVASATACGLLAVLGAHPAPAVAAPTAAAAAGLQQVTGFGSNPGNLQMFAYTPDGVPAGAPLVVALHGCTQSANAYYTNSGWTKYADLWGFDVVFPQTTSANNALSCFGWFDPADSTRGRGEAASVVQMVEYAKQTYGSDGRRVFVTGLSAGGGMTADLLAAYPDVFAGGSVASGLPAQCATSQAAASGCQTGPQKLTPAQWGDKVRGSHPGWTGPWPRVAIWQGTSDYTVYPANATALRDQWTDVWGIGQTPSRTESLPGNTTRSVYDDASGQPAVETFSVSGMGHGLPVSPGSGAEQCGSTAAYFLDTICSAYHTGVFWGLDRTAPGGGTGLPAPAGLKVTGVTSSSASLTWSAVTGAASYTVYRDGAKVATTASTSFTDTGLTAGTAYRYSVTAADPSGTAGAGSSAVTATTTGGAAPATCFTATNYAHVTAGRAHVSGGHAYANGSNQDMGLYNVFVTHTLRESPAGHFVIADSGCQTGSS

SEQ ID NO: 43718 - protein, 294 aa, Streptomyces flavogriseus
  strain ATCC 33331 / DSM 40990 / IAF-45CD
MAKRVMSLIAALGAVIATFVFLPASTASAAACAPAWNASSVYVGGGSASYNGHNWSAKWWTQNERPGTADVWADQGTCGSGGTEEPNPSGFVVSESQFNQMFPSRNGFYTYSGLTAALSAYPGFAKTGSDTVKKQEAAAFLANVSHETGGLVHIVEQNTANYPHYCDTSQSYGCPAGQAAYYGRGPIQLSWNFNYKAAGDALGIDLLRNPWQVEQNAAVAWKTGLWYWNTQSGPGTMTPHNAIVNGAGFGETIRSINGSIECNGGNPAQVQSRIDKYKAFVQILGTTPGSNLSC

SEQ ID NO: 43719 - protein, 265 aa, Streptomyces flavogriseus
  strain ATCC 33331 / DSM 40990 / IAF-45CD
MQHRRLALAAVAALVLTGCSGSGSPEKGLDDPAKKDIAMQLVSSAENSTLDWKARYGYIEDIGDGRGYTAGIIGFCSGTGDMLKVVERYTARRPGNALEAFLPALRAVDGSDSHEGLEDAFTTAWAQAAADPAFRSAQDAERDDSYFDPAVERAEADGLSALGQFIYYDAYVMHGYADAVGTVGFRTIRAQALAEAGPPSEGGDEEAYLDAFLDARVAAMRTETSHGDTSRVETAQRVFVREGRLQLETPLVWKVYGESYRIDGS

SEQ ID NO: 43720 - protein, 288 aa, Streptomyces flavogriseus
  strain ATCC 33331 / DSM 40990 / IAF-45CD
MHHPHTSTSRRTTRLTRTAGLAVLALGLTFTAIPATAQPGVPTSSAAHLEAAATGLDDPAKKDIAMQLVSSAENSTLDWKAQYGYIEDIGDGRGYTAGIIGFCSGTGDMLDLVELYTEREPGNALASYLPALREVDGTDSHEGLDPGFTDAWAEAASDPAFEQAQNDERDRVYFDPAVRQGKADGLGTLGQFAYYDAIVMHGGGTDATSFGSIRQRALAVASPPSQGGDETAYLDAFLDARVWAMKQEEAHSDTSRVDTAQRVFLRNGNLDLDPPLDWKVYGDSFHIG

SEQ ID NO: 43721 - protein, 193 aa, Streptomyces flavogriseus
  strain ATCC 33331 / DSM 40990 / IAF-45CD
MPHSLWLKAAGTAAAIALATATAANAAPTPEPATAVGAAAVVTLRYDDSRAGGWEAAIAAGVASWNQNVSNVKLVEAAPGARAEIQIVATSGWPQATLGPVRPGGQVRVELGSQAVSEGHDKTRIAAHEIGHSLGLPDTKPGPCSQLMSGSSAGITCKNAVPNATERSRVQSTYANGLTSRTPAAGRTLVDAP

SEQ ID NO: 43722 - protein, 174 aa, Streptomyces fradiae
  Streptomyces roseoflavus
IAGGEAIYAAGGGRCSLGFNVRSSSGATYALTAGHCTEIASTWYTNSGQTSLLGTRAGTSFPGNDYGLIRHSNASAADGRVYLYNGSYRDITGAGNAYVGQTVQRSGSTTGLHSGRVTGLNATVNYGGGDIVSGLIQTNVCAEPGDSGGALFAGSTALGLTSGGSGNCRTGGTT

SEQ ID NO: 43723 - protein, 357 aa, Streptomyces fradiae
  Streptomyces roseoflavus
MRRTTRARTGLSALLLAASLGLGAAPAGADAPQRPAPTPASDSAAALHALDAAVERTLGDDSAGTYVDAGTGELVVTVTTEAAAAKVRAAGATPRRVQRGAAELDAAMAALEARAKIPGTSWGLDPRTNRIAVEADSSVSARDLARLRKVAASLDGAVSVTRVPGVFQREVAGGDAIYGGGSRCSAAFNVTKNGVRYFLTAGHCTNLSSTWSSTSGGTSIGVREGTSFPTNDYGIVRYTTTTNVDGRVNLYNGGYQDIASAADAVVGQAIKKSGSTTKVTSGTVSAVNVTVNYSDGPVYGMVRTTACSAGGDSGGAHFAGSVALGIHSGSSGCTGTNGSAIHQPVREALSAYGVNVY

SEQ ID NO: 43724 - protein, 454 aa, Streptomyces fradiae
  Streptomyces roseoflavus
MLHRHAGAAFAAAAAVGALVLTALPGAAAAAPAPPATTPSAAVSMGADKTSPEVLAAMQRDLGLSEPQAQRRLVNEAEAGAVAGRLGGVLGADYAGAWVRGAESATLTVATTDPADALAIRAAGAEARVVRHTLARLDAAKAALDRAAARTDTRDVPVWYVDVRTNSVTVHAAKRGAAEAFLKAAAVNRSLVRVETSAERPRALYDIRGGDAYHMGGGGRCSVGFAVTKGTQHGFATAGHCGRVGTSTSGYNQVAQGTFQGSTFPGRDMAWVAANTNWRSTPYVKGAGGQNVQVTGSTQAVVGASVCRSGSTTGWHCGTIQQHNTSVTYPEGTISGVTRTTVCAEPGDSGGSYISGSQAQGVTSGGSGDCRTGGTTYHQPLNPLLQAYALTLTTTTDPGPGPGEPPEGGTWAAGTVYNAGAQVTYGGATYRCLQTHQAQAGWEPPNVPALWQRV

SEQ ID NO: 43725 - protein, 307 aa, Streptomyces fradiae
  Streptomyces roseoflavus
MNLKRFTPRGGLARGARLTAVAAALVTATALAAPSAGAETADATRASVAELARVSDAVLDADVPGTAWYTDAESGKLVVTADATVSAAELAQLKKAAGDKAGAVEIKRTPGTFNKLIAGGEAIYAAGGGRCSLGFNVRSSSGATYALTAGHCTEIASTWYTNSGQTSLLGTRAGTSFPGNDYGLIRHSNASAADGRVYLYNGSYRDITGAGNAYVGQTVQRSGSTTGLHSGRVTGLNATVNYGGGDIVSGLIQTNVCAEPGDSGGALFAGSTALGLTSGGSGNCRTGGTTFFQPVTEALSAYGVSII

SEQ ID NO: 43726 - protein, 454 aa, Streptomyces fradiae
  Streptomyces roseoflavus
MLHRHAGAAFAAAAAVGALVLTALPGAAAAAPAPPATTPSAAVSMGADKTSPEVLAAMQRDLGLSEPQAQRRLVNEAEAGAVAGRLGGVLGADYAGAWVRGAESATLTVATTDPADALAIRAAGAEARVVRHTLARLDAAKAALDRAAARTDTRDVPVWYVDVRTNSVTVHAAKRGAAEAFLKAAAVNRSLVRVETSAERPRALYDIRGGDAYYMGGGGRCSVGFAVTKGTQHGFATAGHCGRVGTSTSGYNQVAQGTFQGSTFPGRDMAWVTANTNWRSTPYVRGAGGQNVQVTGSTQAVVGASVCRSGSTTGWHCGTIQQHNTSVTYPEGTISGVTRTTVCAEPGDSGGSYISGSQAQGVTSGGSGDCRTGGTTYHQPLNPLLQAYALTLTTTTDPGPGPGEPPEGGTWAAGTVYNAGAQVTYGGATYRCLQTHQAQAGWEPPNVPALWQRV

SEQ ID NO: 43727 - protein, 107 aa, Streptomyces fradiae
  Streptomyces roseoflavus
HAPNALVLTVAKGETARTATPLRAVTLTCAPTPGGTHPAPEAACAELRAVDGRFSALRGDQDRACIKIYDPLVVTAEGVWEGQRVRYERTFGNSCTLQTEAGPVFSF

SEQ ID NO: 43728 - protein, 142 aa, Streptomyces fradiae
  Streptomyces roseoflavus
  MOD_RES (112)..(112): Any amino acid
MRNRAKTALVGTLVAATAALGPLGGTAHAGDSSLYAPSDLVLTIAHGEDAASVAPERAVTLTCEPQARGTHPSPQEACVLLGDAGGDVDAIAPPAEPQLCTYQYDPVVVTCXGVWQGRFVDQERTFGNECVMRAETGAVFDF

SEQ ID NO: 43729 - protein, 109 aa, Streptomyces galbus
SLYAPSALVLTMGHGESAAAVSPARAVTLNCAPSASGTHPAPALACAELRAAGGDLDALAGPADTVCTKQYAPVVITVDGVWQGKRVSYERTFANECVKNASGSSVFAF

SEQ ID NO: 43730 - protein, 276 aa, Streptomyces ghanaensis ATCC 14672
MTARAEQRVSHRRRTAKRRAAIAGFSALGITGAAIVTSTMLSTAGAASAWPSDTGGKPVSKTVPVSGVYDGGMKRFHGTGALGGDSQDEGQDPIFELADGATLKNVVIGTPAADGVHCKGSCTLQNVWWLDVGEDAASFKGKSSSAQYKVIGGGAKKADDKVLQFNGAGTLTVSGFQVEDFGKLVRSCGNCKTQYKRTIVLKDIDVTAPGKSIVGINTNYGDTATLSGIRVHGDGKKKIKTCTRFQGNNSGKEPKDLGSGPDGTYCKFSDSDITYQ

SEQ ID NO: 43731 - protein, 223 aa, Streptomyces ghanaensis ATCC 14672
MRMRMPLSVLTAAGLSLTALGLGTAVPASAAEAPDAGAAFAAYAGSSEEAAANRAFFEAVLKSAAEKRAANPTSAAAVTVVYNASQAPTFATQIARSTQIWNSSVSNVRLQAGTSGADFSYREGNDPRGSYASTDGHGRGYIFLDYRQNQVYNSTRVTAHETGHVLGLPDHYSGPCSELMSGGGPGPSCTNATPNAAERSRVNQLWANGFAAALDKALQKSAR

SEQ ID NO: 43732 - protein, 663 aa, Streptomyces ghanaensis ATCC 14672
MRTGDFDAAWLPPAAFRAVGRRRTLLRAGDGPLVDTVHGEVADACGRFGGRVVRDGGEDAELVLEVTGGPAGAGLGDEGFALARRGGTTTVTASGGRGLLYGLFHVVRLGEDAFRGERPREEHRPALAVRMLDHWDNVAVHPVMGQVERGYAGGSLFWADGRARGDLGRVRAYGRLLAACGVNAVAVNNVNVHETEAHLLTDRIGEVAAIADALRPYGIRTHLSVTFAAPMVLGSLPTADPLDAAVRAWWRGATARVYEAIGDFGGYVVKADSEGRPGPFAYGRSHADGANALAAALEPYGGTVHWRTFVYDHHQDWRDRSTDRARAAYDHFTPLDGEFAPNAVLQVKHGPMDFQVREPVSPLIGAMPRTRLAVEVQATQEYTGQQRHVCWLGPMWSEVLRFRPEGGSGPRVGELARGGLVAVSNAGDDPFWTGHPLAQANLYTFGRLAWDPRADPGAVLDEWIRLTFTPERSADPGRLTDGLHAVLDGSWATYEKYTAPLGVGFMVQPGHHYGPSVDGYEYSPWGTYHFADRDGVGVDRSTATGTGHAGQYAGPWAEVYGSPKTCPDELLLFFHHVPYGHVLHSGRTVIQHIYDTRFEGVAEVEEARRVWAGLADLVDPARHARVAERYEEQLRSAQEWRDQVNSYFLRKSGVPDARGRTIH

SEQ ID NO: 43733 - protein, 293 aa, Streptomyces ghanaensis ATCC 14672
MHRAPPGYVRRPHDAAPPHDPKADGAGAAPASHGASSGVPPRGTPGRPEGTSMSACADNTRPTARKTRTTAVLAGAALLAPLGLLAATGDAWAADDGVWDRIAQCESGGDWHINTGNGYYGGLQFSASTWRAHGGTAYAPTADRATRAQQIAIATKVQRAQGWGAWPTCSARAGASGNAPATGPVTAKESPAKTSKSSGAPGSSDSSDSSGSSGSLCGSSKPSGASKPSKTPARSAGHVERNASRGDYTVRAGDTLSGIAARHGTTWQHLYAANKDAVGADPDLIVPGLRLAL

SEQ ID NO: 43734 - protein, 302 aa, Streptomyces ghanaensis ATCC 14672
MRIKRTTPRSGISRRTRLTAVSAGLVAAAAFAIPSANAADTPTTFSSAELKSVSGSVLKADIPGTAWAVDSKTNRVLVTVDSTVSQAEINKIKQQAGENAGAITIKRTPGTFSKLIQGGDAIYASSWRCSLGFNVRASNGTEYFLTAGHCTDGAGTWYSNSGRTTVLGSTAGSSFPGNDYGIVRYTNSSVSRPGTANGVDITRAATPSVGTTVIRDGSTTGTHSGRVTALNATVNYGGGDIVSGLIQTTVCAEPGDSGGPLYGSNGTAYGLTSGGSGNCSSGGTTFFQPVTEALSAYGVSVY

SEQ ID NO: 43735 - protein, 182 aa, Streptomyces ghanaensis ATCC 14672
GEAPTRTRATGGPGGRRAALAGAGVAAPVAAGVTFRTANAGETPDASGPRALSVAAAGKLASTLAEDLGADAAGTYCAAKGRSLVVNVLAEAATGTVESAGAGARAVANPLAELKSARTALEQDAAVPGTSWVTDPTTDKVVATADRTVSEAEWATRAAARSASPPAAAATAPRAARPSSSR

SEQ ID NO: 43736 - protein, 292 aa, Streptomyces ghanaensis ATCC 14672
MTPSDPDAPGASAPDASGTGTGTGADRRISRKSLLRAAVAAGAAVPLLATGTAALARDAGAQGRSLKPTPFCDDGDDPTPPQMEGPYFKPNSPLRTDLVAPGAPGTRLTVSGHVFGRNCVPLAGVLLDFWQADHAGAYDMAGYTFRGHQFTDSSGAFTLRTIVPGLYPGRTRHIHVKAQAPGRPVLTTQLYFPGEPRNSTDALFDPELLMNVRSAGGGREGTFDFVLDVDGRPTDPPTDPPTDPPSGSWAPGRAYAAGDRVTHGGAAYRCLQAHTSMAGWEPPLVPALWRRE

SEQ ID NO: 43737 - protein, 267 aa, Streptomyces ghanaensis ATCC 14672
MTSATRPRARGRALTGALATLGLSVGMLMSVGSSPASAATWPTPNGSQGVSSTISVSGTKDYGMKRLYGTGDLGSGSQDEDQGPILELADGAVLKNVVLGAPAADGIHCLGSCTLQNVWWEDVGEDAATFKGKSSSAVYTVSGGGAREAGDKVFQFNGAGTLNVSNFAVQNFGTFVRSCGNCSTQYKRTINLNTIEVTWKGSRLAGINTNYGDSATLRNITVIGDSSKKIVPCQKYIGNNSGKEPSTNGSGPDGTYCKYASSDVTYR

SEQ ID NO: 43738 - protein, 392 aa, Streptomyces ghanaensis ATCC 14672
MRRIGLTRAGVAVLLLIGGWTAGGAAPAAANGTSASPTSASSSDSAPASAGLVRAMQRDFGLSRAEAESRLAAERAATELAPEARRTAGSAYGGAWFDTGSEKLTVAVTPDADASTVRALRDSGARVRTVEHSARRLDAAKARIDRLDAPSGVSSWSVDPAANSVVVNVVDGKRDDNDVRRFVDRARAAGPVTVRTAPAAARTFAAGTVGGDPYYTGNARCSIGFSVHGGFVTAGHCGGTGAAVRGWDGSHIGTFQGSSFPGNDYAWVNVGSGWWTVPVVLGWGTVPDRLVRGSAEAPVGASICRSGSTTRWHCGTVLAKNETVNYSQGAVHQMTKTSVCAEPGDSGGAFISGDQAQGVTSGGWGNCSGGGETWFQPVNEILSRYGLTLHTA

SEQ ID NO: 43739 - protein, 324 aa, Streptomyces ghanaensis ATCC 14672
MKGLRMLSGNGRHRRPRQAPALLVAAGVTGSAIAIPLLGAGSASAADGATWDRVAECESGGSWSQNAGNGYYGGLQLTQDDWEKYGGLDYAPSADQASRGQQIAVAERILADRGVGAWRTCGLTAGLEQSSAPVGTGGAGNSTPRASDAPDSSGSSDSGEPSASPSSPSSSPSSDPSSDPSADARGGGGVPGESAGPDAAASPSASTAPKHDESDKSGQPKGSSAFTGDTGTGRHRGASAEEAEGRADEASGRHASRGADASRGAAGGPYTVRSGDSLWSIADSLELEGGWRALYAKNEQAIGADPNLIVPGQELEVGVGQGGE

SEQ ID NO: 43740 - protein, 262 aa, Streptomyces ghanaensis ATCC 14672
MLFSGKGKHRRPSKATRAIAVAGVTGAAVAAPLMAAGNASAATASEWDAVAQCESGGNWSINTGNGYYGGLQFSASTWAGYGGTKYAATADRATKAQQIEIAEKVLAGQGKGAWPVCGKNLSSAPYGGGSTQSPGGGSSQGSQNQSQNQGQGQSQNRSQGQSQNRSQGQNQSQGAGSAETRETERKASRSTERPEAKKTVTTPTGEKVQKGDGEYKVVKGDTLSSIAEEHGVKGGWAKLFDLNDDIVEDADLIYPGQQLHLK

SEQ ID NO: 43741 - protein, 426 aa, Streptomyces ghanaensis ATCC 14672
MPSIDVVVAREILDSRGNPTVEVEVGLDDGSTGRAAVPSGASTGAFEAIELRDGDANRYLGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAETFSEALRWGTEVYHTLKKVLKSKGLATGLGDEGGFAPNLGSNREALDLILEAIREAGYTPGEQIALALDVAASEFYKDGSYVFEGKERSAAEMTEYYAELVEAYPLVSIEDPLFEDDWEGWKTITAKLGDKVQLVGDDLFVTNPERLARGIEENAANALLVKVNQIGSLTETLDAVELAQRNGFKCMMSHRSGETEDVTIADLAVATNCGQIKTGAPARSERVAKYNQLLRIEEILDDAAVYAGRSAFPRFKG

SEQ ID NO: 43742 - protein, 190 aa, Streptomyces ghanaensis ATCC 14672
MHVRTLTGGLAAVLVMSFPLLGGQAVAAPSGGTAGPSAAARVLTYDATGAAEFRSAVDRGAAIWNESVDTVELRPAASGQRADIRVLADSGWPRALPTSLGKGTVYIGRQAVNQGYNTVRISSHELGHILGLPDRKPGPCSSLMSGSSAGTSCTNPYPNAAEREEVEGNFAGAASTGTPVPAPRAVPVPG

SEQ ID NO: 43743 - protein, 446 aa, Streptomyces ghanaensis ATCC 14672
MTRLAAVGGLLLGATMVTRAVASEPAPPNAVPHTAAGQSAGPGTDLASRLGTSRTAGSWIDADGRTVVAVTDEEAAGEVRRAGAEPKMVRHSMRELKSAAKTLRSAPRVPGTAWVLDYRSNEVVVRGDSTVSADDWSELTRVAEGIGDFVRMERTEGTFTTRLNGARPILSTAGRCSAGFNVTDGRRDFILTAGHCGPDGSVWFTGDRDREEVGTTVGGSFPGDDYSLIEYADGRAGEGADVVAVGGGKGIRITGVADPAVGQRVFRSGSTSGLQDGEVTALDATVNYPEGTVSGLIETTVCAEPGDSGGPMFSEGIALGVTSGGSGDCAAGGTTYFQPVTKALEQLRVQLIVSPQAGGGGEAAASPAPSSPEGAAAPDSASPGSSAPATGIANASTLLSRLADPQNAGPGLLVIGGSLIALVATRWIRAEQDRKAYRRRYSATWG

SEQ ID NO: 43744 - protein, 420 aa, Streptomyces ghanaensis ATCC 14672
MSHKRIPKHKAAIAAGGVVALGAAAILLPNANASQDGASDDAAAAPKTLKATDASDLASQLAGLLGDAFAGSYYDGDKQQLVVNVVPGDDNNVIVQAKKAGAAVREVDNSMGELEAGAQTLQEQATIPGTSWAVDPRTNKILVTADSTVTGGKWDRLESTVRRLGSGMATIEKSAGTFKTFASGGDAIFAGGSRCSLGFNVTAGDGAPAFLTAGHCALAGDRWSDSQGGQPIATVDQALFPGRGDFALVRYDDPATQAPSEVDLGDQTVQISRAAEATVGQEVFRMGSTTGLADGRVLGLNATVNYPEGTVTGLIQTDVCAEPGDSGGSMFTRDGLAIGLTSGGSGDCTVGGVTFFQPVTTALQAVGATLDAAGAGVGAEEAAGQEADGEEVGAGEEAGQDAGQEAGQDAGYGTGPGSTH

SEQ ID NO: 43745 - protein, 304 aa, Streptomyces ghanaensis ATCC 14672
MSRKGVAPLSRRRISAVLTAVILAGSAPILLPAATASAASCSSYPAWVAGKSYNAGDIVRYTDGRAYIAEHANPGYDPTISTWYWEPYACDNGPGTPVGNFVVTEAQFNQMFPNRNSFYSYSGLTAALSAYPGFANTGSDTVKKQEAAAFLANVSHETGGLVHVVEQNTANYPHYCDWGQPYGCPAGQAAYYGRGPIQLSWNFNYKAAGDALGIDLLNNPWLVQNDAAVAWKTALWYWNTQSGPGTMTPHNAMVNQAGFGQTIRSINGSLECDGKNPAQVQSRVNTYQRFAQILGTTPGGNLYC

SEQ ID NO: 43746 - protein, 443 aa, Streptomyces ghanaensis ATCC 14672
MTRVTDFGANPGQLNMYVYRPASLPAGPAVVFALHGCSQDAQTYADNSGLPELADRHGFLVVFAETTFSNNMSKCFNWFEPTDNRRGQGEAASIRQMAAHTASAYGADTRRTYVTGLSAGGGMTSVMLAAYPDVFRAGAVVAGLPYGCADDVMSAFTCMSPGTDLTPAQWAQRVRDAHPSWSGPWPRVAVWHGDKDTKVVPRNADELRDQWTALHGLSQKPTRTSVIGPNSTRHEEYAAADGSVAVEVNRVPGIGHGTPVDPGGGAQQCGRAGTAHFLDSICSSHWITRFFGLSEGSEDDGLPAPTGLTVTGATDTAISLRWDPVDGADGYTVYRDGAPLAAADTTSYADTGLTAGSSHTYAVAARDAGGGTGRLSGTVTARTTGGVTACWTASNYAHVQAGRATTSGGYTYAKGSQQNMGLYNLFVIRTLRESPAGHFTLAD

SEQ ID NO: 43747 - protein, 398 aa, Streptomyces ghanaensis ATCC 14672
HTDPADWAGLTPQGLAVPEGVPGIQVDGYFPDSSTTNTNHGWNHDAQFVIRLPDRWNGGLVVAGTPGNREQYANDRAIADWVLARGYAYAATDKGNTGLDFHRDGSRPGDAVAEWNTRLTQLTRAARSVVAQRYHRPPARTLVTGMSNGGYLVRWQLENHPELYDGGVDWEGTLWHSEGPNLFTFLPPALRHYPAYAAGGPDADRARKELHRAGFPAGSEFLWPFHHQVYWDLTQRIYREEFDPAFDGATEAGTPYCASGTPGCDADYDYAARPAEVHKAVQRVALTGRIGKPLITIHGTLDVLLPIGEGSDVYSRMIREAGRGHLHRYYRIEDGTHTDSLVDGFPDRLRPLLPCHRSSFTALENWLTTGQRPPANHTVVRPEDATAASLLTSCRLDG

SEQ ID NO: 43748 - protein, 261 aa, Streptomyces ghanaensis ATCC 14672
MTAARPRLLQDITGGDAFYVNDSTRCSVGFSVTRDDRPGFATAGHCGRPGDTTTGYDRTAQGTFRASTFPGKDMAWVATGDQWTATPDVKAQDGQEVQVTGSAQALVGAAVCRSGSTTGWRCGTIEQHDTSVSYPEGRVDGLTRTTVCAEPGDSGGPYLAGSQAQGVTSGGSGDCTDGGTTFYQPVNPVLADFGLTLTTTAARTTAPAPQDGTAREEWTSGRVYETGATVTRDGVRYRCLQTHQAQGAWAPAGTPALWQRL

SEQ ID NO: 43749 - protein, 418 aa, Streptomyces ghanaensis ATCC 14672
MAVRGRHRRYQPNRINRASLTVTAGGAGMALPLMGAGTAQAADVGTWEKVAACESSNDWDINTGNGYYGGLQFTQSTWEAFGGTRYAPRADLATRDQQIAIAEKVLDGQGPGAWPVCSARAGLTRGGDTPDIRPAADRSDRSGGKGGKTDGGDRKAGGGKTGRSSVEDVRPHTTPQSRAGRAEMYTVVRGDTLSGIARDERVRGGWKGLYEANRSAVGADPDLILPGQRLALPEPSGTAARTPAGKTSKAPQKPSKRTAGTAEKKRTAPQRTEDRADRATEKAGGTLVAPVGGALGTPYHKAGSAWSKGYHTGIDFPVPTGTSVKSVAAGRVVGAGWEGSFGYQVVVRHADGRYSQYAHLSAISVRSGQSVAAGQRIGRSGSTGNSSGPHLHFEVRTGPGFGSDVDPVAYLRAGGVRI

SEQ ID NO: 43750 - protein, 122 aa, Streptomyces ghanaensis ATCC 14672
MTSRRNAHAGNGCGAHGSRTRTALMVLVTAVVLGTPAQAVASPSIVSGRTDWDAIAACESDGNWQANTGNGHYGGLQFTQSSWVAAGGLEYAPRADLATREEQIAVAERLARLQGMSAWSCA

SEQ ID NO: 43751 - protein, 461 aa, Streptomyces ghanaensis ATCC 14672
MPGDLPDHARDHHPAAHGHPADLAAPAGLARDDTARGGRRHRAGPGPAGARGLRTDAVPPALLKSMERDLGLDRQQAERRLANEAEAGATAGRLRAALGSDFAGAWVRGAESGTLTVATTDARDVRTIEAQGAEADVVRHSLADLDAARARLDRAAARTGTTDAPVRYVDVRTNKVVVQAVRTSAARALVSAAGVDASLLRIEKSAERPRPFYDLRGGEAYYINNSGRCSIGFPVTKGTQQGYATAGHCGRAGASTSGHNRVAQGTFQGSTFPGRDMAWVATNTNWTATPYVKGAGSQNVQVTGSTQAPVGSSVCRSGSTTGWHCGVIQQLNTSVTYPEGTITGVTRTSVCAEPGDSGGSYISGSQAQGVTSGGSGNCSSGGTTYFQPINPLLQTYGLTLKTNGDGGGEEPPPGGGTWSAGTVYQPGDTVTYGGATYRCLQSHQAQAGWEPPNVPALWQRV

SEQ ID NO: 43752 - protein, 226 aa, Streptomyces ghanaensis ATCC 14672
MVAPLLAITLPAGMANAHGWVTDPGSRQDQCAQGVVDCGQIKYEPQSVEGPKGLRSCSGGNAQFADLDDDRKAWRVTPVGGSHTFTWKLTARHATDTWQYFVGDRKIAEFNDRGAQPPAQVSHQVDFGDLKGRQKVLAVWNVADTNNAFYACIDVDIAGGGNGGGDNGGGNGGGGSDSCAAPVWSTGTVYHGGDTVTHDGRTYRAKWWTTNERPGSADVWEDLGAC

SEQ ID NO: 43753 - protein, 282 aa, Streptomyces ghanaensis ATCC 14672
MYFVMPTDSADAPAAPPAATAQAAREDAKDRAEEERAEDDALIAGLPAGLAAPEKKELAQRLVASVQNSTLDWRSLYGSIEDHGDGQGYTAGIIGFCSGTHDLLMLVEHYSEEHPGNGLERYLPALREVDGTDSHEGLDPGFTAAWRAEAELPEFRRAQEEMRDRLYFEPAVRLAKLDGLDTLGQFVYYDAMVFHGPDTDPEGFYGLRERVMEKARTPARGGSEKAYLDAFLDVRREAMLTKRPGSDTSRVDTAQRRFLEAGNLKLDTPLVWRAYGGTFRVP

SEQ ID NO: 43754 - protein, 800 aa, Streptomyces ghanaensis ATCC 14672
MTRSGATTTATTAKTVLKAAQEAAASGAGDIEGWLVPSYGDGSRTDGGAGDLGVNGGVGDPMESHPGGDDGGTRPAATGDCRPDGLATTPGVATPYCKVYQSDGREWLGEGRSRRVVGYFNGGRTGADGTPHYLVKNIPWSKVTHLNYAFASVENNKIKVDSNATQKEWPGEVGAEMDPSLPYKGHFNLLTKYKRLHPRVKTLISVGGWAGSGGFYTMTTNADGSVNQGGIDTFASSVVDFLRTYGFDGVDIDFEYPTVLEDTGNPADWAVANPRRKGLPTTYAALMKTLRDSLNRASVADNKYYLLTSASSASGYLARGMANQTALDYQDFTNLMAYDYHGTWNDVVGPNAALFDDGKDPELADQYATPEYGKIGYFNTDWAMKYMRGAMQAGRVNIGVPYYTRGWQNVTGGTNGLWGTSQKSSGCEPGTGIKRPCGDGAFGIDNIWHDETNNGSELGSGTNPLWHAKNLEKNITPVYAPSVGLKPHADVTDRRTGHYTRYWDDTTKTSWLWNAEKKVFLSTEDEQGIDAVTDLVKSTGAGGVMMWELGGDYACPADVQPDTPCGMGYTLTTRLNQKLGNIGAYDNSLRTGSSGAAPTVTANVSVELVNYPTSTANLWPLQPTVRITNNTGRTLGGGKDTKLSFDIPASTSWLVKDGNWQTDAQGGQWKLTPGTTLHRISTTLDYCQIIPAGKSLDLPIIYYLPITGPVNTSLSIGGTAYAPVTDNLKGLGTATPPAGGCSAGNWDATKVYSPASQPIEQTTVKYNGKVWKAKWETKGNAPGTGADADHEPWKLIGSAS

SEQ ID NO: 43755 - protein, 294 aa, Streptomyces globisporus
MPAYSSLARRGRRPAVVLLGGLVSASLALTLAPTAAAAPLAPPPGKDVGPGEAYMGVGTRIEQGLGAGPDERTIGPADTSGVQGIDVSHWQGSINWSSVKSAGMSFAYIKATEGTNYKDDRFSANYTNAYNAGIIRGAYHFARPNASSGTAQADYFASNGGGWSRDNRTLPGVLDIEHNPSGAMCYGLSTTQMRTWINDFHARYKARTTRDVVIYTTASWWNTCTGSWNGMAAKSPFWVAHWGVSAPTVPSGFPTWTFWQYSATGRVGGVSGDVDRNKFNGSAARLLALANNTA

SEQ ID NO: 43756 - protein, 402 aa, Streptomyces griseoaurantiacus M045
MRRLRACLGAVAALGIAAAGSTALLAGNASGATNALSDRWYAAAPYLMPLDNDPPDAAAIMDATGLKAFQLAFVLAPNGGGCSPTWGGTSPVSSDTAVQAVIDRIRSKGGDVSVSIGGYGGTKLGQTCSDAASTAAAYQQVITKYGLHAIDFDLEEPEYENAAAIRNEIGAAKILQRNNPGLYVSVTTAGTTAEGTGWFGKQMLLEAKSQGFTPNNFSIMPFDGGFNGAAAQTDALTKFNRILQSTFGWNEATAYAHEGFSGMNGRSDTGEYFPQADFQTVLDYATSHHMDRFTFWSLNRDRQCSPPDNGGRTSGTCSSVAQNAWDFAKYAVRFAGVTPPTTTPTPTPSSPGTACKAAWSSSAVYVKGDEVSYGKHNWKAKWWTQNETPGAEWGPWEDEGSC

SEQ ID NO: 43757 - protein, 789 aa, Streptomyces griseoaurantiacus M045
MAPRTARSKDEGTGTGARYAVISPEKIPQFTGDLAQLEKDYGDLRTDASHLRSTGADVHSRFQGLSAYYEAPEAEQLFASTKPVKDRADDFATDLETVSSALSSYTTEVRPLAKKLADLKARATTFVNSVKDDEDWQYDEDKVEEHNGIRDEITETVAAFWAAERTCHNKITAIFGGTQMVAGDGSDRKDQYGFAADDMKNAKLPWGDPVEEKHHLWEVGHWVKSFVWDGLIVDGVWGTIKGLGTLVGFGGWEAMGQAWKGLAQLATGLAISSIPGVGNAFWTLPDEKLPSWLRDSRTAVKQTGKALVAWDEWGKNPARAAGAVTFNVVTTVFTGGAGAAASGAGKAGAVARALSVAGKAGKVIDPMTYVMKGAGAGLSKIGDVTSALKGVGKIDVPSLPDGSVHLPDGRILDPQGHLTTPDGVVDTTPVPHEAAPGLPAHWTVPAQSAHVPGAPALHAADTAGTYGPTHYAPEPPAPHTPHEPPAGPPHPTHETPAGGHGGEHQHGGDHPHGGDHDGPAHVDDAGQAVDTHQMPDAVAHHGPENPPPPGHTAPDTPGHGATGEPFEYRPAMSDADFDALSNAEKHAVAEAELARGTNPAPSVSDEAGLAYGNAYWNDFLDDLPDESRQALRTYSGNDYDLINGHLRAGDPLSAELKNTIAEMDEVMDTRPVPEDVMIVRGTAVDYVKVNGRPIDTPFDMVDGVFGDKAFTSTALGRTPPPPFDGKPVWMHLRVPKGTPALWIDHLSKYPGERELLLARGSEYKVTRVFFDEAQNKWHLYGEVLPRPKP

SEQ ID NO: 43758 - protein, 404 aa, Streptomyces griseoaurantiacus M045
MRRTTFRAAGLRSTTLRTAGLSAALLLVSAAAGLGQASAATSGSSGSSGSSSDAHAGTRAAAAAPALVDALQRDLHLTKAQATDRLAAETSARTVEKAARKAAGSSYGGSWFDAAHGTLVVGLADDSHRAAVEATGARVTRVAHTERTLDATMTKLNAMDAPGGVAGWHVDPKSSTVTVTVVDAHKSDNDVAKFLSRAREAGPVNVEKTSHQPRTLAAGTVGGDPYYTGNVRCSIGFSVQGGFITAGHCGTPGMSVSGWDGSYIGNFQGSSFPDNDYAWVNVGSGWWTVPVVLGWGTVSDQLVRGSGEAPVGASICRSGSTSHWHCGTVLAKNETVNYSQGAVHQMTKTNACAEPGDSGGSFISGDQAQGTTSGGWGNCGSGGETWFQPINEVLNRYGLRLHTA

SEQ ID NO: 43759 - protein, 318 aa, Streptomyces griseoaurantiacus M045
MFTPLRSTIRTAALTLSAVTALILGTTAMTGAAAAPATAPAPAPAPAPAPAPAKQGPTSVAYVEVNNNSILNAGKYTLARGGNVFDIAVIFAANINYDTATKTAYLHFNDNVQRVLDNAATQIRPLQQKGIKVVLSVLGNHQGAGFANFTSQRSAAAFAHQMSDAVRTYGLDGIDFDDEYAEYGNNGTAQPNASSFVQLVTALRADMPDKIISLYNIGPAASRLSYGGNDISSAFDYAWNPYYGSWQVPRIALPKSKLSPAAVEIGRTSRSTVADLARRTVGEGYGVYLTYNLDGSDRSADITAFTRELYGSDALYTP

SEQ ID NO: 43760 - protein, 466 aa, Streptomyces griseoaurantiacus M045
MRHVRRRIVRRGIRLSAVGGILLGGLMVTQAMATEPAGGTPAPGAHAAGSSVESAAARGAGLVSRLGTGRTAGTWIGADGRPVVAVTDAGAAGTVREAGARAEVVRHSMDELRSATKSLRTAPRVTGTAWSVDYTRNEVVVRADPTVSAGDWSRLTRLADSLGGRVRMERTKTEFTTRLNGAQPMFSTGGRCSAGYNVTDGQGSFILTAGHCGPKGAVWFADQGGATELGQTVSSRFPGNDFSLIRYGNGQSAGADTNVIAIGGGKGVRIAGAGDAAVGQRVFRSGSTSGLRDGKVTGLDATVNYPEGTVTGLIETDVCAEPGDSGGPLFSDGLALGVTSGGSGDCESGGTTFFQPLRTAMSALGVRLAGDGSGGKPSSAAAGAPEPSASASQGAVIAPGSANPGAVEQVGAGAAPSLAARLTDPGTVGPGLLVLAGSMVAWVAARYIRSERDREAYRRQYARSWS

SEQ ID NO: 43761 - protein, 434 aa, Streptomyces griseoaurantiacus M045
MSHKRIPKRKAAIAVGGVAALGAAAFLLPHANASQTDSDDSTPRTFKAADVPGLSAQLRARLGDTFAGSYYDAAGRRIVVNVVGGDESAMNAVKEAGAVPHQVRNSTGALETAARTLRTDAAIPGTAWSVDPRTNEIRVTADSTVTGAGWDRLESTVERLGSGMATLKKSEGTFKTFVSGGDAIFGGNARCSLGFNVTAGDGSPAFLTAGHCGVAVDQWADDENGQPIATVDQATFPGEGDFSLVKYDDPATQAPSEVNVGGGKVVAIGKAAEAAVGQQVLRMGSTTGLHDGTVLGLDATVNYPEGTVTGLIQTDVCAEPGDSGGSLFSEDGSAIGLTSGGSGDCDAGGETFFQPVTTALQATGATLGEGGGQATGGGQADDQGGGQAGDQGAGQAGGQAGDQAGGQAGDQTGGDAQAGGSGLESSRHGQRRGH

SEQ ID NO: 43762 - protein, 146 aa, Streptomyces griseoaurantiacus M045
MPSPARWTAALTLSAAAVCGPLALPAAAAHAAPAGPASLYAPTALVLSVGHGERAADATAERAVTLSCAPTPSGTHPAPAEACAELRTVDGDPASLSPGDGVLCTKEYDPVVVTVEGVWRGKRLSYERSFANPCVKNAYGPAVFAF

SEQ ID NO: 43763 - protein, 302 aa, Streptomyces griseoaurantiacus M045
MPKRRLSARLSALLATLVLGTAAPLLSSTPASATAAASCSSYPSWAAGRSYATGDIVRYTDGRAYIAEHDNPGYDPTISTWYWEPYACDDGGSTNPSGFVVSEAQFNQMFPNRNSFYTYSGLRAALSAYPGFANTGSDTVRKQEAAAFLANVSHETGGLVYVVEQNTANYPHYCDWNQPYGCPAGQSAYYGRGPIQLSWNFNYKAAGDALGIDLLNNPGLVQSDASVAWKTGLWYWNTQSGPGSMTPHNAMVNGAGFGQTIRSINGSLECDGRNPAQVQSRVDAYQRFVGLLGTSAGGNLYC

SEQ ID NO: 43764 - protein, 123 aa, Streptomyces griseoaurantiacus M045
MIGHQNSDAVLRHEPRRRGIRTALTLLTTAAALFTAPAALAASAPAGPRGPDWDAIAACESSGNWQANTGNGHYGGLQFKQSSWVAAGGLQYAARADLATRAEQIAVAEKLAALQGLSAWACS

SEQ ID NO: 43765 - protein, 438 aa, Streptomyces griseoaurantiacus M045
MAVRGRHRRYQPNRINRASLTVTAGGAGMALPLIGTGVAHAADADTWNKVAACESSGNWHINTGNGYYGGLQFTQSTWEAYGGRAYAARADLATREQQIVVAEKVLDGQGPGAWPVCSDRAGLARGGAGPDIDPGAHTQTARRTPERQAPAKGQAPAEKRTSHKDVAPHATPQSRAGTAEMYTVVHGDTLSGIADTHDVRGGWHGLYAANRTTVGSDPDLILPGQRLTLDGARATSPAGKRDTSDGTEERAGTKDKERAGAKAREKTKKAEKREKREKGDKREKPKERHETSPHRSTATATAGHKVVAPVADLGIGTRYRASGSSWSRGYHTGVDFPVATGTSVRAVSSGHVVSAGWGGSYGYQVVVRHADGRYSQYAHLSAISVRAGQNVATGQRIGRSGATGNVTGPHLHFEVRTGPGFGSDIDPVAYLRAGGVRL

SEQ ID NO: 43766 - protein, 449 aa, Streptomyces griseoaurantiacus M045
MARRHVGAGCAVLTALGSLVLMSPSPATATAPSVPPAEGPSAEVLHALGRDLGLTPAEARQRLSNEAEAGTRAGRLHNALGSRFAGAWVHGKTSAGLTVATTDKADVAAIEAGGADAKVVKVALADLRSAKQKLDTAATAAEATRGRRTPVRYVDVVNNRVTVQATSKAAADDLIKAAKVDRRRVSVTVSKDLPRALYDITGGDAYYINDEARCSVGFSVTKGEQQGFVSAGHCGNAGDTTTGYNQVDQGTFQNSVFPGHDYSWVATDDDWTATPHVKGEGGATVTVSGSVQALVGASVCRSGSTTGWHCGTIQQHDTSVTYPEGTVTGVTRTTVCAEPGDSGGPYISGSQAQGVTSGGSGDCTRGGTTYYQPVNPALSAFGLTLVTDTATTQTPGTTPEPESGTWAAGAVYDVGAQVTYGGVTYVCLQPHQAQGAWQPAATPALWQKV

SEQ ID NO: 43767 - protein, 302 aa, Streptomyces griseoaurantiacus M045
MRIKRTTSRSGMSRRTRLIAIGSTLVAAAAFAVPSANASDTAATFSNAQLTRAGGSVLQADVPGTAWAVDKANHRVVVTVDSTVSESEITKIKQAAGSESGALTIKRTPGTFKKLIGGGDAIYASSWRCSLGFNVQDSSGNYYFLTAGHCTDGAGTWWSNSSHSTTLGTTAGSSFPGNDYGIVRYTNSSVSKAGSVGSVDITSAGTPSVGTTVYRRGSTTGIHSGRVTALNATVNYGGGDIVSGLIQTTVCAEPGDSGGSLYSNSGIAYGLTSGGSGNCSSGGTTFFQPVTEALNAYGVHVY

SEQ ID NO: 43768 - protein, 190 aa, Streptomyces griseoaurantiacus M045
MWDRIARCESGGNWHIDTGNGYYGGLQFSAGTWRAYGGTAYAATADGASREAQIAVATRVQRAQGWGAWPVCSARAGATGSAPAASGGTASGSGRSSGSSGGSGGSGTSNSAPHRAAPESAPSRRTAPADRPARHADRGASRGDYTVRTGDTLSGIAERHGTTWQRLYTANSDVIGADPDLIVPGRRLDL

SEQ ID NO: 43769 - protein, 183 aa, Streptomyces griseoaurantiacus M045
MRRRVLSLISALACAGAVALGTPSPAGAAAPEPETVPIDLLLAGSYAEPVREAMRIWNTSVPGIRFVEQSTPASLRVKEYTTATGTGSHVYVNGLGRGWVYLETGDAQVYRPTRVAVHELGHILSLPDLGPGSPCSKVMSGGWAGPECVNTQPDAEEISEVAAFFAAHDVGDPVPGWPPPSDD

SEQ ID NO: 43770 - protein, 288 aa, Streptomyces griseoaurantiacus M045
MGRCGDRTLYRMKRVRHLLWAAVTVLVVATVYGLTPGPGDRGRDDGAGRKSDGTGLGSPAKKEIAQQIVASAENGTLDWRSAYGYIEDIGDGQGYTAGIIGFCTGTHDLLTLVEKYTEEHPGNRLARYLPALRAVDGTDSHEGLGAGFTAAWKAEARVPAFRRAQDAERDRVYFDPAVRRAEEDGLGALGQFVYYDAIVFHGPGTRPGSFGGIRAAALRRAKSPAEGGPEAAYLGAFLDVRRAAMRKRGPEVDTSRVDTAQRVFLREGNLELNPPLVWRVYGERYEIG

SEQ ID NO: 43771 - protein, 291 aa, Streptomyces griseoaurantiacus M045
MPIVAGVVHLALPDGGSDAPGEPSAAASAAARAAHGKERRADDAVVADAPPGLAGPALKELAQRFVSSVENSTLDWRTAYGAIEDTGDGHGYTAGIIGFCTGTDDLLTLVERYTEAHPDNGLARYLPALRAVNGSDSHEGLDPGFTSAWRAEARVKAFREAQEEERDRVYFDPAVRLAKLDGLGALGQLVYYDAMVLHGPGLDADGFYGLREKALQRADLPSDGGSRKDYLNAFLDVRRAAIERSGADRPHGDTSRIDTALRTFVDKGYFELRTPLEWRVYGERYRVDHVS

SEQ ID NO: 43772 - protein, 429 aa, Streptomyces griseoaurantiacus M045
MPSIDVVVAREILDSRGNPTVEVEVGLDDGSTGRAAVPSGASTGAFEAIELRDGDPSRYLGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKNKGLATGLGDEGGFAPNLGSNREALDLILEAIKEAGYTPGDQIALALDVAASEFYKDGVYSFEGKDRTAAEMTDYYAELVDAYPLVSIEDPLFEDDWAGWKTITDRLGDKVQLVGDDLFVTNPERLARGIEEGTANALLVKVNQIGSLTETLDAVELAQRNGFKCMMSHRSGETEDVTIADLAVATNCGQIKTGAPARSERVAKYNQLLRIEEILDDAAVYAGRSAFPRFRSAGQ

SEQ ID NO: 43773 - protein, 237 aa, Streptomyces griseoaurantiacus M045
MLFSSKGKHRRPSKATRVVALAGVTGAAVAAPLMAAGSASAATASQWDAVAQCESGGNWSINTGNGFFGGLQFTSSTWAAYGGTAYAARADLASKSQQIAVAEKVLAGQGKGAWPVCGKGLTGAAYDGAAASSGSSSNGSSNSSSSSSAGSSSSSSSTEQHASRSQERPAAKKTVTTPTGKKVEKGDGEYKVVKGDTLSGIAAEHHVKGGWQKLFTLNKDIVDDADVIFPGQQLHLS

SEQ ID NO: 43774 - protein, 334 aa, Streptomyces griseoaurantiacus M045
MLSGNGRHRRPRQAPALLVAAGVTGSAIAIPLLGATGASAASGSTWDHVAECESGGSWSADTGNDLYGGLQLSQDDWNHYGGLDYAPSPDKASRSQQIAVAEKILAAEGVAAWPTCGPLSGLSKDSGSADVDTGLGSGSGESGKSGSGLDLGLDNSSGNSDSSASSGSSGSSESSGKSSGKSGSTSDEASGKASASPSKKGEDSSRASGDSRSGGKSTTSPESSDKSGDSSAGRASGSASEHYRQSPGSSALVDTGAVDGTKGANTLIADGTGRHRGSSAEDGSTYTVRHGDTLGSIADSLDVDGGWQALYQANEDAIGSDPSVIRPGQSLVVE

SEQ ID NO: 43775 - protein, 463 aa, Streptomyces griseoaurantiacus M045
MNTRPQDTPAHPPAPSAYPSNPTRPSYPTLPSHTPYTPYTPYTPYTPTYVPTEPYGYGVHEAETVPVLPRQGGPVAPGGTVARDGTVRRGARRKPPARPEAVRRLVPQALVVAFLAGGTTAFVAKDKAVELNVDGRRRTLHTFAEDVTGLLAEQGLDTGAHDLVTPGPDTALSSGDEIDVRHGRPLRLTLDGQRHRVWTTARTVDAALRELGVRVEGAYLSVARSRHIGRAGLALDVRTERTVTVMADGRERRVRTNAATVREAVAQAGVVLRGQDTTSVAPDGFPRDGQTVTVLRVRGHREVREEPVPFEERRTEDPALFRGTEVVDDAGRAGVRRVTYGVRTVNGVRQPPRRLRTEILREPRARVVRVGTRPLPASVAGAEGLDWEGLARCESGGRADAVDPSGTYGGLYQFDARTWHELGGRGQPEAAPPAEQTYRAKKLYVRRGAAPWPHCGERLRGGA

SEQ ID NO: 43776 - protein, 296 aa, Streptomyces griseobrunneus
MFKRVLSLLVALGAVVAAFVVLPAATAQAATCFSAWNSSSVYTGGQTASYNGRNYTAKWWTQNERPGSSDVWTDNGACGTGGGGEDPGQSNGFVVSEAQFNQMFPNRNSFYTYRGLTDALSAYPAFANTGSDEIKKREAAAFLANVSHETGGLVYIEEVNEANYPHYCDASQPYGCPAGQSAYYGKGPIQLSWNFNYKAAGDALGIDLLNNPYLVEQNAAVAWKTALWYWNTQTGPGTITGHNAIVNGPGFGETIRSINGAIECNGGNPAQVQSRIDKFTQFTQVLGTTTGSNLSC

SEQ ID NO: 43777 - protein, 339 aa, Streptomyces griseocarneus
MAQARSPTPTPGAAVPFTQRTATAALFTAAALTAALPQTAMAAPAAATPSLKVLTYNTFLMSTGLYPNWGQEHRAREIAAAGFFQGNDVVVLQEAFDNAAADGLKAAAADRYPYQTPVVGRSRDGWDATGGKYSATTPEDGGVTVLSKWPIVRKEQVIFNDACGADWWSNKGFAYVVLNVGGTRVHVVGTHAQSTDSGCAAGEAAADRSRQFRQIDAFLDAKNIPADEQVMLAGDLNVDSHSAEYASMLADGDLAPADSRAGHPYSFDTKENSIAAYRYPTDPREDLDYVLHRNGHARPAGWRNTVVQETSAPWTVSSWGKRYTYTDLSGHYPVIAGAN

SEQ ID NO: 43778 - protein, 177 aa, Streptomyces griseoflavus Tu4000
MHLRTLTGGLAAVLLLSGPALTGPAEAVPSGDTGPAAAGVITYDTSGAAEFKAAVDRGAAIWNKSVESVELRPAASGQRADVRIVADNGWPRSLPSSLGGGTVYLGRQAMDQGYYTVRVTAHELGHMLGLPDRKPGPCSSLMSGASAGLSCTNPYPSAAERAQVEKNFENARAGVLM

SEQ ID NO: 43779 - protein, 226 aa, Streptomyces griseoflavus Tu4000
MRMPMSVLTAAGLSLTALGLGAAPATAAPAPLDAGSSDTSYAAYDGSEEAAANRAFFEAVLKSAAEKRAANPTSAAAVTVVYNASRAPSFATQIARSTQIWNSSVSNVRLQAGTSGADFSYYEGNDSRGSYASTDGHGRGYIFLDYRQNQMYDSTRVTAHETGHVLGLPDHYSGPCSELMSGGGPGTSCTNAYPNSAERSRVNQLWANGFAAALDKAEKALQKSSR

SEQ ID NO: 43780 - protein, 121 aa, Streptomyces griseoflavus Tu4000
MISGRSTQRDDGRSSRVSANRTALIVLVAAAALGTTTPAMASPSVPRGTDWDAIAACESSGNWQANTGNGHYGGLQFTQSSWEAAGGLKYAPRADLATRKEQITVARRLARIQGMSAWSCA

SEQ ID NO: 43781 - protein, 447 aa, Streptomyces griseoflavus Tu4000
MTRVTDFGANPGQLNMYVYRPASLPDRPAVVFALHGCSQNAQLYADNSGLPELADRHKFLVVFAETTTANNMSKCFNWFQPADTRRGQGEAASIRQMAAHTVSAYGADSGRTYVTGLSAGGAMTSAMLATYPDVFQAGAVVAGLPYGCAGDLVAAGTCMSPGTDLTPAQWAQRVRDAHPSWSGPWPRMAVWHGDKDTKVVPRNADELRDQWTALHGLSQTPARTSLIGPNSTRHEEYTAADGSVAVEVNRVPDIGHATPVDPGSGPQQCGSTGTANFQDSLCSSHWITEFFGLAEPVEDDGLPAPTGLTVGDATDTTLRLSWEPVDGADGYLVHRDGAPLTTVGATSYTDSGLTPGTSHTYAVAARGADGTTGRLSGLVTARTTGGTAACWTASNYAHVQAGRATTSGGYTYAKGSGQNMGLYNIFVTHTLKESPAGHFTLADGTCS

SEQ ID NO: 43782 - protein, 474 aa, Streptomyces griseoflavus Tu4000
MVLSTGISAGWRGRAVLGALALSTAVALLPSSASARPASDRAGHCANQSHLRVPGAAHQRSDCLNELTTAGTVASGHTDPADWAGLTPKDLTVPEGVPGIQIDGYFPDSSTTNTNHGWNHDSQFVIRLPDRWNGGLVVAGTPGNREQYANDRAIADWVLARGYAYAATDKGNTGLAFHQDGSRPGDAVVEWNNRVTQLTRAARAVVAQRYHRPPTRTLATGMSNGGYLVRWQLENHPELYDGGVDWEGTLWDAKGPNLFTFLPPTLRHYPAYAAGGPDAEAARAAMHEAGFPAGSEFLWPFHHQVYWDLTQRIYREEFDPSYDGATEAGTPYCAPRTPGCDADYDYAARPAEVHKAVQRVALTGRIGKPLITLHGTLDVLLPITKDSDVYARMIREAGRGHLHRYYRIEDGTHTDSLADAFPDRLRPLLPCHRSSFTALESWLTTGHRPPASHTVARPEAATPASLLTSCRLDG

SEQ ID NO: 43783 - protein, 300 aa, Streptomyces griseoflavus Tu4000
MKRAGVLLLAAVPVIATGVYFVMPADSADTPPAPPGATAPPAREHAKDRAEQERDEDDSVVAGLPPGLASPAKKELAQQLVASAEHATTDWRTTYGVIADEGDGCGYTAGIVGFCSGTHDLLLLVESYTEDHPDNGLASYLPALREVDGSDSHEGLDPGFPAAWKAEAEVPAFREAQEAERDRIYFDPAVRLAKLDGLGTLGQFVYFDAMVFHGPDTDADGFYALRERTLKQAKTPAAGGTEETYLNAFLDIRREAMLTRYPEHDASRVDTAQRRFLEAGNLGLETPLAWEMYGESYKLP

SEQ ID NO: 43784 - protein, 232 aa, Streptomyces griseoflavus Tu4000
MTDTAGVRGTPHETALLAGGPRAAVTVALVALHLRGAVEAGAPGTLRAVDGEAGRALPPLPPPGVGLEPPDGDTAGPADAVTSEVRAAYLESAVYHCLREPSEAAELVRDPVVRWAVAEVRVGLAEAGMLRYPLLRPTRAARRRLKTLRKAYPLPASRRELSDHQRLLAVALHGEAALRVVVPRFALRAGLTDRVSLRDKGLLRSSSRGGTYGGGGSHACGSGTSCGAGGPD

SEQ ID NO: 43785 - protein, 276 aa, Streptomyces griseoflavus Tu4000
MTARPEQRVSHRRRTTRRRAVIAGLSAFGITGAAIVTTSMLSTAGAATSWPSDTGSKPVSSTVAVSGTYDGGLKKFYGTGDLGGDSQDEGQDPIFELADGATLKNVIIGTPAADGVHCKGSCTLQNVWWLDVGEDAASFKGTSSSAQYKVIGGGARKADDKVLQFNGAGKLTVTGFQVEDFGKLVRSCGNCKKQYKRTVVLSDIDVTAPGKSIVGINTNYGDTATLSKIRVHGDSKKKIKTCTRYQGNSSGKEPKDLGSGADGTYCKFSATDVTYD

SEQ ID NO: 43786 - protein, 301 aa, Streptomyces griseoflavus Tu4000
MRIKRTTPSSGISRRTRLIAVSTGLVAAAAIAVPSANASDAPTTFSSAELKSVSGSVLKADVPGTAWAVDSKTNRVLVTVDSTVSQTEINKIKRQAGDDAGAITIKRTPGKISKLIQGGDAIYASSWRCSLGFNVRSSSGAEYFLTAGHCTDGAGTWYSNSARTTVIGSTAGSSFPGNDYGIVQYTGSVSRPGTANGVDITRAATPAVGTTVIRDGSTTGTHSGRVTALNATVNYGGGDIVYGLIQTTVCAEPGDSGGALYGSNGTAYGLTSGGSGNCSSGGTTFFQPVTEALSAYGVSVY

SEQ ID NO: 43787 - protein, 360 aa, Streptomyces griseoflavus Tu4000
MKHRRIPRRRAVMAGAGIAALAAGAVTFQTANASESPADAAPRILSVQAAGKLASTLAQDLGADAAGTYYDAKSKSLVVNVLDEAAAETVESAGAEARVVANSLAALKGAHTTLKQDATIPGTSWVTDPTTNKVVVTADRTVSEAEWAKLTKVVDGLGAKAELQRTKGEYKPFVAGGDAITGNGGRCSLGFNVTKGGEPHFLTAGHCTEGISTWSDSSGSVIGENADSSFPGDDYGLVKYTADVAHPSEVNLYDGSTQAISGAAEATVGMQVTRSGSTTQVHSGTVTGLDATVNYGNGDIVNGLIQTDVCAEPGDSGGSLFSGSSAVGLTSGGSGDCTSGGETFFQPVTEALSATGTQIG

SEQ ID NO: 43788 - protein, 339 aa, Streptomyces griseoflavus Tu4000
MCFHTPHHGRPHRRDRPRRRVRARPRSGVSSSGSGRVPRRSRSLSRRRIAAVTAALVLAGSAPVLLPAATASAAACSSYPNWVAGRSYNAGDIVRYTDGRAYIAEHANPGYDPVISTWYWEPYACDNGPGTPAGNFVVTEAQFNQMFPGRNSFYTYSGLTAALSAYPGFAKTGSDTVKKQEAAAFLANVSHETGGLVHVVEQNTANYPHYCDWGQPYGCPAGQAAYYGRGPIQLSWNFNYKAAGDALGIDLLGNPWLVQNDAAVAWKTALWYWNTQTGPGSMTAHNAMVNQAGFGQTIRSINGSLECDGRNPAQVQSRVTKYQQFTQILGTSPGGNLYC

SEQ ID NO: 43789 - protein, 364 aa, Streptomyces griseoflavus Tu4000
MSITAQLRDSVRLPGGRVLVNGFALESRGDGSHRALLRNGHELEVHDLRELFAGERAPAAVFPLPWPRWDHGVHSVSPDGTFAVFSGQRSVRAMAAGGRTLWEYRHGCWGPELGHPHTGDEQEVCRGLESGSCRISDDGRLVWAHVVAEQEPGEAEERWVVLDARDGRELASLPLDSAAAGSNHLSHPDGAHMGLGIGMGQDGILLYWARWDGEKLTGWDVNEGLDRILTDVHAGHPGFLTVEHYGADLRLHALDGTVIAEQEPEPADDEDGAGGGDETYWDYGCGFVDAGTVIASTVEADEEPEQARHWLLDAHTLRIRGVVTYPTGPVDSYVRPLGDGTWLTYDETSETLSRWAQSVTSGTG

SEQ ID NO: 43790 - protein, 308 aa, Streptomyces griseoflavus Tu4000
MTGSAIAIPLLGAGSASAADGATWDRVAECESGGSWSQNTGNGYYGGLQLTQDAWENYGGLDFAPSADQASRGQQIAVAEKILADQGVGAWRTCGLLSGLEQGSASADIDTGVSEDSTKSGSGSSDSLDSSGSSRSSDSSESSPSSGSSDDEGVAGDSAKSDKSSDSGKDSDTASDGGSGASPSASNAPKSDESDKSGQSTGSSRAVDGEDTGNGRHRGVSAEEGDGGDRTPGSSGRHASRGADASRDAADGSYTVRTGDSLSSIADSLELKGGWRSLYAVNEQVVGVDPDLILPGQELEVGVEPGEK

SEQ ID NO: 43791 - protein, 236 aa, Streptomyces griseoflavus Tu4000
MLFSTKGKHRRPSKATRALAVAGVASAAVAAPLMAAGNASAATASEWDAVAQCESGGNWSINTGNGYYGGLQFSASTWAAYGGTQYAASADQASKAQQIEIAEKVLAGQGKGAWPVCGTGLSGAAYSGSSSNGSGSSQGSGSTETRETEQKASRSAERPAAEKQAEPKAEQKTVTTPTGKKVEKGDGEYKVLKGDTLSSIAKEHDVKGGWAKLFELNDDIVDDADLIFPGQQLHLK

SEQ ID NO: 43792 - protein, 426 aa, Streptomyces griseoflavus Tu4000
MPSIDVVVAREILDSRGNPTVEVEVGLDDGSTGRAAVPSGASTGAFEAIELRDGDANRYLGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGTEVYHTLKKVLKSKGLATGLGDEGGFAPNLGSNREALDLILEAVKEAGYTPGEQIALALDVAASEFYKDGVYTFEGKERSAAEMTEYYAELVEAYPLVSIEDPLFEDDWEGWKTITAKLGDKVQLVGDDLFVTNPERLARGIDEGAANALLVKVNQIGSLTETLDAVELAQRNGFKCMMSHRSGETEDVTIADLAVATNCGQIKTGAPARSERVAKYNQLLRIEEILDDAAVYAGRSAFPRFKG

SEQ ID NO: 43793 - protein, 410 aa, Streptomyces griseoflavus Tu4000
MGPSETCRRDLRGREKHSRLHTEKPWFRTVGRGFDSRHLHSSHVGRGPVAGSGGASVMRPHDRAWRCGDHTHIDRWFTVLPSLSMTQTRAALRPTVLTALLAALLSVLLTPTPASAASLQEVTGFGSNPGALKMYRYVPDGLPAGRPVVVALHGCTQNAAGYATGTGWTTLADRWGFSVVLPQQQSGNNSSQCFNWFQDADIRRGQGEAASVAQMVDRQLADVSGNASRVYVTGLSAGGGMTSVMMAAYPEKFAAGGVVAGLPYGCAQAAGSPFVCMYVGATQTPAQWGDRVRAARPGYTGPWPALTVLHGTADYTVKPVNMTDLVEQWTDVQGADRTADVSDTVAGHPHQIFRGPDGKAVVETYGIDGMGHGQPVDPGSGTEQCGTAGAYFLDVGLCAAHRLGKAWQLG

SEQ ID NO: 43794 - protein, 265 aa, Streptomyces griseoflavus Tu4000
MTSSKRPRARALTGALATLGLSVGMIMTTGASPANAVTWPTANGSQAVSSTIAVSGTKDYGMKRLYGTGDLGSGSQDEDQGPILELADGAVLKNVILGAPAADGVHCKGSCTLQNVWWEDVGEDAATFKGKSSGSVYTVSGGGAKEASDKVFQFNGAGTLNVSNFSVKNFGTFVRSCGNCSTQYKRTINLNTIEVNWKGSKLAGINTNYGDSATLRNITIIGDSSKKIVPCQKYIGNNTGKEPSTNGSGPDGTYCKYASSDVTYK

SEQ ID NO: 43795 - protein, 421 aa, Streptomyces griseoflavus Tu4000
MAVRGRHRRYQPNRINRASLTVTAGGAGMALPLLGSGAAQAADVETWDKVAACESTNDWSINTGNGYYGGLQFTQSTWEAYGGTRYAPRADLATKDQQIAVAEKVLDGQGPGAWPSCSVRAGLSRGGDTPDIRPAAGRSDGNAAKSDGGRSGRSSVEDVKPQTTPQSRAGRAEMYTVVRGDTLSGIASDERVGGGWHVLYDANRSTIGGDPDLIMPGQRLSLPGGTAKAPAEPATGAGKTDKKAGGKAEKKTENKAEKKTEKTEGKTEKQASPRTDDRADRAAKTGGGGLVAPVSAALGTPYHKAGSAWSKGYHTGVDFPVPTGTSVRSVGGGTVVSAGWEGSFGYQVVVRHADGRYSQYAHLSAISVKSGQSVGAGQRLGRSGSTGNSSGPHLHFEVRTGPGFGSDVDPVAYLRAGGVRI

SEQ ID NO: 43796 - protein, 144 aa, Streptomyces griseoflavus Tu4000
MRNTARWATTLGLTAAAVCAPLSGAALAAPGNAPSALYAPSALVLTMGHGDSAATATPERAVTLTCAPGASGTHPAAGAACAEMNRAGGDLDALTVSEGVHCTLQYDPVLVTVDGVWQGRRVSYERTFSNECVMNAHGSSVFAF

SEQ ID NO: 43797 - protein, 357 aa, Streptomyces griseoflavus Tu4000
MPLRVRESCMRHARRRVVRRVTRLAAVGGLLLGATMVTHAVAGEPGAPAAVPFSTAEETTPGPGAVVVAELGTSRTAGSWIAGDGATVVAVTDEEAAAEVRRAGAEPKLVRHSMDDLKTATKKLSSATRVPGTAWAMDYRSNQVVVRGDSTVSADDWSGLTEVADGIGDFVRMERSGGVFTTRVNGAQPILSTAGRCSAGFNVTDGKRDFVLTAGHCGPEGSVWFADDRARQEVGTTVAGSFPGDDYSLIRYAGGRAGEGAGVVAVGDGKGVRITGVADPTVGQRVFRSGSTSGLRDGEVTALNATVNYPEGTVSGLIESNVCAEPGDSGGPMFSEGVALGVTSGGSGDCRTGGTTY

SEQ ID NO: 43798 - protein, 107 aa, Streptomyces griseoincarnatus
YAPSALVLTVGKGVSAATVTPERAVTLTCAPGPSGTHPAADSACADLAAVGGDLDALTRSEGVMCPMIYDPVLLTVDGVWQGERVSYERVFSNECEMNAHGSSVLAF

SEQ ID NO: 43799 - protein, 19 aa, Streptomyces griseoluteus
CANSCSYGPLTWSCDGNTK

SEQ ID NO: 43800 - protein, 294 aa, Streptomyces griseus
MYRRVMSLLVALGAIVAALIVLPATTAQAATCATAWSSSSVYTNGGTVSYNGRNYTAKWWTQNERPGTSDVWADKGACGTGGEGPGGNNGFVVSEAQFNQMFPNRNAFYTYKGLTDALSAYPAFAKTGSDEVKKREAAAFLANVSHETGGLFYIKEVNEANYPHYCDTTQSYGCPAGQAAYYGRGPIQLSWNFNYKAAGDALGINLLANPYLVEQDPAVAWKTGLWYWNSQNGPGTMTPHNAIVNNAGFGETIRSINGALECNGGNPAQVQSRINKFTQFTQILGTTTGPNLSC

SEQ ID NO: 43801 - protein, 297 aa, Streptomyces griseus
MTFKRFSPLSSTSRYARLLAVASGLVAAAALATPSAVAAPEAESKATVSQLADASSAILAADVAGTAWYTEASTGKIVLTADSTVSKAELAKVSNALAGSKAKLTVKRAEGKFTPLIAGGEAITTGGSRCSLGFNVSVNGVAHALTAGHCTNISASWSIGTRTGTSFPNNDYGIIRHSNPAAADGRVYLYNGSYQDITTAGNAFVGQAVQRSGSTTGLRSGSVTGLNATVNYGSSGIVYGMIQTNVCAEPGDSGGSLFAGSTALGLTSGGSGNCRTGGTTFYQPVTEALSAYGATVL

SEQ ID NO: 43802 - protein, 299 aa, Streptomyces griseus
MRIKRTSNRSNAARRVRTTAVLAGLAAVAALAVPTANAETPRTFSANQLTAASDAVLGADIAGTAWNIDPQSKRLVVTVDSTVSKAEINQIKKSAGANADALRIERTPGKFTKLISGGDAIYSSTGRCSLGFNVRSGSTYYFLTAGHCTDGATTWWANSARTTVLGTTSGSSFPNNDYGIVRYTNTTIPKDGTVGGQDITSAANATVGMAVTRRGSTTGTHSGSVTALNATVNYGGGDVVYGMIRTNVCAEPGDSGGPLYSGTRAIGLTSGGSGNCSSGGTTFFQPVTEALSAYGVSVY

SEQ ID NO: 43803 - protein, 449 aa, Streptomyces griseus
MRFAYGRLPWRRGAVLGSALLVLVTAPAASTATERSGPAPARSVILLIGDGMGDAEITAARNYSVGAAGRLAMDTLDASGRRTTYAVDERGRPVYVTDSAAGATAWATGRRTVNGRVSKSHDTDRPMPTLLELARDRGYATGSVTTASVADATPAALTAHVTDRSCKGPADMAACPADTRAGGGEGSIAEQTVAARPDVLLGGGADHFAQTVTDGPFRGRTVTQQARAAGYQVVRDRTQLAAARPGRPVLGLFAPEYVPVEWTGPPAAPGGTAPQRCATRNPGRPAGTPDLAESTRAALDLLTARAHHRGAPGRGFFLQVEGASIDDRAHEADPCGQLGETLAFDRAVAAALDHAERHPRTLVIVTADHGHATQILPHDARPAGLSATLVTDEGGVMQLGYGTALPGETQEHTGVPVPVAARGPLADRVRGVQDNTSLFGTVTAALGLR

SEQ ID NO: 43804 - protein, 457 aa, Streptomyces griseus
MERTTLRRRALVAGTATVAVGALALAGLTGVASADPAATAAPPVSADSLSPGMLAALERDLGLDEDAARSRIANEYRAAAVAAGLEKSLGARYAGARVSGAKATLTVATTDASEAARITEAGARAEVVGHSLDRFEGVKKSLDKAALDKAPKNVPVWYVDVAANRVVVNAASPAAGQAFLKVAGVDRGLVTVARSAEQPRALADIRGGDAYYMNGSGRCSVGFSVTRGTQNGFATAGHCGRVGTTTNGVNQQAQGTFQGSTFPGRDIAWVATNANWTPRPLVNGYGRGDVTVAGSTASVVGASVCRSGSTTGWHCGTIQQLNTSVTYPEGTISGVTRTSVCAEPGDSGGSYISGSQAQGVTSGGSGNCSSGGTTYFQPINPLLQAYGLTLVTSGGGTPTDPPTTPPTDSPGGTWAVGTAYAAGATVTYGGATYRCLQAHTAQPGWTPADVPALWQRV

SEQ ID NO: 43805 - protein, 392 aa, Streptomyces griseus
MCVSRRRNSGRPILRVRAPHLLRARPHRRSKLKHRRISRKRATLAGSAVVALVAAGFTFQTANASDDVPAFGAKTLSADAAGKLATTLDRDLGADAAGSYYDATAKTLVVNVVDEAGAEQVRQAGGKARIVENSLAELKSARGTLTEKATIPGTSWAVDPVSNKVLVTADSTVDGAAWKKLSAVVEGLGGKAELNRTAGEFTPLIAGGDAIWGSGSRCSLGFNVVKGGEPYFLTAGHCTESVTSWSDTQGGSEIGANEGSSFPENDYGLVKYTSDTAHPSEVNLYDGSTQAITQAGDATVGQAVTRSGSTTQVHDGEVTALDATVNYGNGDIVNGLIQTTVCAEPGDSGGALFAGDTALGLTSGGSGDCSSGGTTFFQPVPEALAAYGAEIG

SEQ ID NO: 43806 - protein, 284 aa, Streptomyces griseus
APDIPLANVKAHLTQLSTIAANNGGNRAHGRPGYKASVDYVKAKLDAAGYTTTLQQFTSGGATGYNLIANWPGGDPNKVLMAGAHLDSVSSGAGINDNGSGSAAVLETALAVSRAGYQPDKHLRFAWWGAEELGLIGSKFYVNNLPSADRSKLAGYLNFDMIGSPNPGYFVYDDDPVIEKTFKNYFAGLNVPTEIETEGDGRSDHAPFKNVGVPVGGLFTGAGYTKSAAQAQKWGGTAGQAFDRCYHSSCDSLSNINDTALDRNSDAAAHAIWTLSSGTGEPPT

SEQ ID NO: 43807 - protein, 13 aa, Streptomyces griseus
AAAPDIPIANVNA

SEQ ID NO: 43808 - protein, 147 aa, Streptomyces griseus
MRRNPHAAFATVTATALLLGGFATATAQAAPAGAPSLYAPSALVLTVARGEDPLTATVERAVTLTCAPTAEGTHPTPAAACKELAAVQGKFSELTAGPSNRTCTRQWDPVVVSAHGAWQGRQVRFSTTYGNACEMAGSTNGNAVFAF

SEQ ID NO: 43809 - protein, 355 aa, Streptomyces griseus
MRRNSRARLGVSLLLVAGALGLGAAPSTAADTPPAAPSAIPAPSAYALDAAVERQLGAATAGTYLDAKTGGLVVTVTTDRAEEQARAAGATVRRVARSAAQLDAAMATLEAEAKITGTSWGVDPRTNRVAVEADSSVSARDMARLEAVAERLGSAVDIKRVPGVFHREVLGGGAIYGGGSRCSAAFNVTKGGARYFVTAGHCTNISANWSASSGGSVVGVREGTSFPTNDYGIVRYTDGSSPAGTVDLYNGSTQDISSAANAVVGQAIKKSGSTTKVTSGTVTAVNVTVNYGDGPVYNMVRTTACSAGGDSGGAHFAGSVALGIHSGSSGCSGTAGSAIHQPVTEALSAYGVTVY

SEQ ID NO: 43810 - protein, 457 aa, Streptomyces griseus; identical to SEQ ID NO: 43804

SEQ ID NO: 43811 - protein, 721 aa, Streptomyces griseus
MAPAEGSLWPDAVFADPDPDTDAESYVLSGRMADSFVRLNTMAQAYRQQGTGLTGNTALRDAVLTGLEHLSIQVYNDGQSRYGNWYSWQIGAPQALLDVCVLMYDAIAQERLARYCAAVDHFVPDSAVASYTGTSTGANRVDLCRVLALRGVVGGRRRRSHWPATRLPRLPPGDQGDGLYADGSFIQHTTVPYTGSYGSVMLGGLGLLFALLKGTTWEVTDPKRQVVFDAVENAWAPFLYNGLVMDSVAGRAISRGEVDDHRRGHPIMASIVLLGRGASAAENARWRGLVKGWAQRDYYSPPLSNPSLGLTALARLKSVLDDTSLTPVAEPAGHRLFPDMARATHRRPGWAASLSMADRRVTYYEAGNGENLRGWHTGSGMLYWWGDTFANGQYSDAFWPTVDPYRLPGTTASRKVLADGAGGDWGVSLPDVNWVGGVTDSKRAAVGQYLKGLTSTLMAKKSWFFLDDTVVCLGAGIHGRDGAAVETTVDNRNLGPTGNAPFTVDGSVKPLTLPWSATLTGASWAHLAGHGGYVFPGGATVKALREDRTGRWRDINKAGSTDPVSRKYLTLWFDHGQDPTDATYAYQLLPGASPQRTAARAADSGWLRMLANTDAQQGVSVPSLRLTAVNFWFGGTVGPLVADAPCSVMVTEHADGTATVCVSDPMRARTSLTLTWNRAVASVVSKPATVTSAATGASLRLVFGDLSGTRGATQTVKVRLS

SEQ ID NO: 43812 - protein, 294 aa, Streptomyces griseus; identical to SEQ ID NO: 43800
  subsp. griseus
  strain JCM 4626 / NBRC 13350

SEQ ID NO: 43813 - protein, 273 aa, Streptomyces griseus
  subsp. griseus
  strain JCM 4626 / NBRC 13350
MTAAPAATAAAPAAGPCAPLHSASADYRAGDTVSHHGRNWSAKWWTRGENPGAGSAWSDRGACTGGVSDFVIGEEEFDAIFPDRDPFYTYQGLIDALHAYPRFANVGTPQTRAREAAAFLTHADFESVGLKYVKEINEANYWRKCDDTQPFGCPAGREAYYGRGPIMFSWNFNYKAAGDALGLDLLNDPWLVERDPSVAWATALWYWNTQNGPGTMTSHDAMVGGAGFGETIRSLNGALECDGGNPGSVTARVERYERITGIVGVAPGAGLTC

SEQ ID NO: 43814 - protein, 218 aa, Streptomyces griseus
  subsp. griseus
  strain JCM 4626 / NBRC 13350
MRHLPTALASAVAGLGLVAALGSAPAVSAAPAPATSTPASIAAYNGSGENAAANRAFFDAVMKSVAEKRAANPGAQAVTVTYSAASAPSFRTQIANSTRIWNSSVSNVRLQEGSRADFTYREGNDPRGSYASTNGHGRGFIFLDYRQNQQYNSTRVTTHETGHVLGLPDNYSGPCSQLMSGGGPGPSCTNAQPDANERARVNQLWQNGFAAASVPAGS

SEQ ID NO: 43815 - protein, 434 aa, Streptomyces griseus
  subsp. griseus
  strain JCM 4626 / NBRC 13350
MAPKAVEPTVIQSVTARRILDSRGNPTVEADVRLADGSLGRAAVPSGASTGAREALELRDGDAGQWHGKGVDRAVAHVNGEIAAAVAGRDADDQAGLDAALVALDGTPDKSRLGANAILGVSLAAAKAAAAAHRRPLYRYLGGADARLLPLPMMNIVNGGAHADNPLDFQEFMIAPVGARTFAEAVRMGSEIFHTLRGDLLAAGHATAVGDEGGFAPALRTAEEALDFVMSAVERSGYRPGADIGLIMDPASSEFFRDGAYAYAGEGVRRTPSEQVDYLVELIDAYPIVSVEDPMAEDDLDGWRELTARVGGRCQLTGDDVFCTDEEQVRQGIRTGVGNSVLVKVNQIGTLTEALATVATARRAGWSAVMSHRSGETEDTTIADLAVATGCGQIKTGSLSRSDRTAKYNRLLRIEEELGGSARYAGGELLSRSR

SEQ ID NO: 43816 - protein, 192 aa, Streptomyces griseus
  subsp. griseus
  strain JCM 4626 / NBRC 13350
MLESRWLKAVGVAAAITLAAATAAQAAPAPEPAAEDASAVVTLRYDDSRAGGWEAQIAAGVASWNSNVDNVKLVEAAPGTRAEIQIVATSGWPQATLGPVRPGGQVRVELGSQAVAQGHDKTRIAAHEIGHSLGLPDTKPGPCSQLMSGSSAGTSCKNAVPNAAEQSRVESAYAGGLASRVPADGRVLVDAP

SEQ ID NO: 43817 - protein, 722 aa, Streptomyces griseus
  subsp. griseus
  strain JCM 4626 / NBRC 13350
MAPAEGSLWPDAVFADPDPDTDAESYVLSGRMADSFVRLNTMAQAYRQQGTGLTGNTALRDAVLTGLEHLSTQVYNDGQSRYGNWYSWQIGAPQALLDVCVLMYDAIAQERLARYCAAVDHFVPDSAVASYTGTSTGANRVDLCRVLALRGVVGGKAAKIALARDALSPVFPLVTRGDGLYADGSFIQHTTVPYTGSYGSVMLGGLGLLFALLKGTTWEVTDPKRQVVFDAVENAWAPFLYNGLVMDSVAGRAISRGEVDDHRRGHPIMASIVLLGRGASAAENARWRGLVKGWAQRDYYSPPLSNPSLGLTALARLKSVLDDPALTPVAEPAGHRLFPDMARATHRRPGWAASLSMADRRVTYYEAGNGENLRGWHTGSGMLYWWGDTFANGQYSDAFWPTVDPYRLPGTTASRKVLADGAGGDWGVSLPDVNWVGGVTDSKRAAVGQYLKGLTSTLMAKKSWFFLDDTVVCLGAGIHGRDGAAVETTVDNRNLGPTGNAPFTADGSVKPLTLPWSATLTGASWAHLAGHGGYVFPGGATVKALREDRTGRWRDINKAGSTDPVSRKYLTLWFDHGQDPTDATYAYQLLPGASPQRTAARAADSGWLRVLANTDAQQGVSVPSLRLTAVNFWFGGTVGPLVADAPCSVMVTEHADGTATVCVSDPMRARTSLTLTWNRAVALVVSKPATVTSAATGASLRLVFGDLSGTRGATQTVKVRLS

SEQ ID NO: 43818 - protein, 297 aa, Streptomyces griseus; identical to SEQ ID NO: 43801
  subsp. griseus
  strain JCM 4626 / NBRC 13350

SEQ ID NO: 43819 - protein, 147 aa, Streptomyces griseus; identical to SEQ ID NO: 43808
  subsp. griseus
  strain JCM 4626 / NBRC 13350

SEQ ID NO: 43820 - protein, 457 aa, Streptomyces griseus
  subsp. griseus
  strain JCM 4626 / NBRC 13350
MERTTLRRRALVAGTATVAVGALALAGLTGVASADPAATAAPPVSADSLSPGMLAALERDLGLDEDAARSRIANEYRAAAVAAGLEKSLGASYAGARVSGAKATLTVATTDASEAARITEAGARAEVVGHSLDRLEGVKKSLDKAALDKAPKNVPVWYVDVAANRVVVNAASPAAGQAFLKAAGVDSGLVTVARSAEQPRALADIRGGDAYYMNGSGRCSVGFSVTRGTQNGFATAGHCGRVGTTTNGVNQQAQGTFQGSTFPGRDIAWVATNANWTPRPLVNGYGRGDVTVAGSTASVVGASVCRSGSTTGWHCGTIQQLNTSVTYPEGTISGVTRTSVCAEPGDSGGSYISGSQAQGVTSGGSGNCSSGGTTYFQPINPLLQAYGLTLVTSGGGTPTDPPTTPPTDSPGGTWAVGTAYAAGATVTYGGATYRCLQAHTAQPGWTPADVPALWQRV

SEQ ID NO: 43821 - protein, 287 aa, Streptomyces griseus
  subsp. griseus
  strain JCM 4626 / NBRC 13350
MTPQMDNSTPHEPNASDEASVDRRRISRKGLLKAALVASAAPLLVGGGVALARDAASSGNGPLAPTPECDDGDDVTPPQMEGPYFKPNSPRRTSLVTPSTPGVPLTVSGYVFGRACRPISGALLDFWQADTNGSYDMAQFAFRGHQFTGADGSFSLTTIVPGLYPGRTRHIHVKAQAPGGRILTTQLYFPNEPRNNTDALFDPELLMNVRNVGNGRQGSFDFVLDVAQTPNPTATPTEPGSTTWATGTSYRAGDRVTYGGVAYRCLQAHQAHAGWEPPNVPALWERG

SEQ ID NO: 43822 - protein, 450 aa, Streptomyces griseus
  subsp. griseus
  strain JCM 4626 / NBRC 13350
MAANGRHRRYQPSRINRASLTVTASGAGIALPLITAASAGAAPVEVWEKVAACESSGDWSVNTGNGYYGGLQFSGSTWAAYGGTQYAPRADLATRDQQIAIAEKVLDGQGPGAWPTCSVPAGLTRGGDAPGAAPDSGPDTQSAGRSTVRAAAPQSAPPRQPRTRPVETTPTHVPGKRDSYTVASGDSLSGIASAQRVRGGWQGLYAANRTVVGADPDLIFPGQRLSLDQSRAPKAGEGKKSAQPERKAAPKPPAGTAEARKADRPRAAPKKEAPAQAAPKKEAPKQQAPEKAAPKQQAPKKEAPAKERSAPERAVKHSGFSAPVSAGTGTPYRQAGGWSSGYHTGVDFPVPTGTSVKSVAPGRVVSAGWAGAYGYEVVIRHNDGKYSQYAHLSALHVRAGQSVSGGQRIARSGSTGNSTGPHLHFEIRTGPGYGSDVDPLAYLRAGGVRV

SEQ ID NO: 43823 - protein, 380 aa, Streptomyces griseus
  subsp. griseus
  strain JCM 4626 / NBRC 13350
MRHATLLRTGLSALLVIGAWTAAGPVSASAAPAPAEPPASAALLSAMQRDLGLTEKQALTRLADEKAATALEKKAQRAAGSAFGGSWLDAKSGKLTVAVTTAEKAEAVRATGAGARLVEHSAKSLDAAKARIDALKAPSGVSSWHVDPATSRVVVNVVAAEQTDNDVRAFVTKARKAGPVTVRTTAEAPQTFAAGTVGGDPYYTGNVRCSIGFSVHGGFVTAGHCGGTGQQVRGWDNSYIGNFQGSSFPGDDYAWVNVGSGWWTVPVVLGWGTVPDQLVRGSNEAPIGASICRSGSTTRWHCGRVLAKNETVNYSQGAVHQMTKTSVCAQGGDSGGSFISGDQAQGVTSGGWGNCTSGGETWYQPINEILNRYGLRLHTA

SEQ ID NO: 43824 - protein, 406 aa, Streptomyces griseus
  subsp. griseus
  strain JCM 4626 / NBRC 13350
MKHGKKNARRYIVAASIGALLSAGVATGAYAGTTEEPSAPAAAPAYQPEMVKALATTLGVSEKAAVARLDREADQQGRFAELRKDRVDTLGAFFAEDGSLVVNAADAKAAEDVRAAGLKARVPERGESELDRIKARLDAKALKSAPAGVSAWSVDLASDTVTVEVNGDSDAATRSFLEAARSNGDAVRVVKGQEKLETQAVVPPGSRMTFNGYLCSVGYGAKDRNGKQVLVTAGHCIEDLPALAYNGTRFAKGTHTRFALGTRSVDMGIATVDAGNSIGLDVTTYGRAGTVPVKGSKRAPSGAALCKSGQTTQWTCGKVGSYNVSVTYTDQNGGPDTVVTGLASSSVCTQGGDSGGAYISGDQAQGMTSGGPTNQRCNGQVNSPGSSYFQPLDDALAYYGLTLNTK

SEQ ID NO: 43825 - protein, 326 aa, Streptomyces griseus
  subsp. griseus
  strain JCM 4626 / NBRC 13350
MPNTAFRRLTGVALSAALATATLAVSAPPAAAAETPSLRVLSYNAFIFSKTLYPNWGQDHRAAEIPKTSFFRGNDVVVIQEAFDNGASDALLRNSASPYPYQTPVVGRSKSGWDATGGSYAAATPEDGGVTILSKWPIVRKEQFVFKDACGGDWFSNKGFAYTVLNVNGARVHVVGTHAQSTDPGCSAGQAAQVRSRQFKQLDAFLDAKNIPASEQVVVAGDFNVDGHAAEYASFLADAGLSAPETRTGHPYSFDTRDNSIAAERYPDDPREDLDHVLHRTGHARPAGWKNEVIKEESAPWTVSSWGKDYTYTNLSDHYPVIGSGR

SEQ ID NO: 43826 - protein, 391 aa, Streptomyces griseus
  subsp. griseus
  strain JCM 4626 / NBRC 13350
MPPAPPRQSPARGAARRPAERRRTLVANPESLRRLVPKALVVAFLAGGTTAFVAHDKAVRLNVDGTPRTLHTFADDVTGLLAEEGVTVGAHDVVTPAPGTALGHGDAVVVDHGRPVTLTLDGVRRQVWTTADTVAGALRAFGIRAEGAHLSAPRSTRIARTGLTLTVRTERTVTFMADGQERTLRTNAATVHEALAEAGITLHGQDTTSVAPTSFPRDGQTISVMRITDTREVHEETVPYAVERSEDPALFRGTEVIERAGRNGVRRVTYAVRTVNGVRQRPRRTAEELVHPPVSRVVRTGTRPRPATVAGADGLNWSALAACESGGRPGAVDASGTYGGLYRLDTQTWQSLGGSGRPQDAPAAEQTHRAKKLYVQRGASPWPHCGRRLTG

SEQ ID NO: 43827 - protein, 344 aa, Streptomyces griseus
  subsp. griseus
  strain JCM 4626 / NBRC 13350
MGSANGRHRRPRQAPAIVVAAGVTGSAIAIPLLGAGGAQAAEATTWDRVAECESGGMWSADLGNGYYGGLQFSQETWSAYGGTAFAPRADLASRSQQISVAEKVLDDQGPKAWPSCAVISGLAVDGGLPGVDPGASPSADPSADPSADPEPAPTGETDATGESGESGKGAKGDEVDKGGTGGAEKGSRDPDSSVKPSAPPASGAPDAADPSAAPDASAGESGKGGKHRGAPAPEEADAGQEDGPRESGRHASRGDSGARDGGAAADGGYTVRPGDNLWAIADAQEVPGGWTGLYETNKDLLGSDPDLILPGQNLDLGLDRDAGGSADPAAREGAETPAGAPAAN

SEQ ID NO: 43828 - protein, 234 aa, Streptomyces griseus
  subsp. griseus
  strain JCM 4626 / NBRC 13350
MLLNSKGKHRRPSKAVRIATLAGVTGAAVAVPLMGATSASAASVETWDAVAQCESGGNWSINTGNGYYGGLQFSQSSWAAAGGTQYASRADLASKDQQIATAEKLLDLQGPGAWACAGAGGLTNDGVDPGVNTGSGSGESKPEQAQPERQAEQPTTRSEQREAPKAESEKTVTTPTGQKVQKGDGEYKVKAGDTLSTIAEAEGVKGGWSKIFKLNDDIVKDADLIFPGQQLHLK

SEQ ID NO: 43829 - protein, 426 aa, Streptomyces griseus
  subsp. griseus
  strain JCM 4626 / NBRC 13350
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATENKASLGANAILGVSLAVAHAASEASDLPLFRYLGGPNAHLLPVPMMNILNGGSHADSNVDIQEFMIAPIGAESFSEALRWGAEIYHTLKKVLKTKGLSTGLGDEGGFAPNLESNRAALDLIVEAIKEAGYVPGRDIALALDVAASEFYKDGVYEFEGKSRSAAEMTEYYEELVSAYPLVSIEDPLYEDDWAGWKVITDRIGAKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAVYAGRSAFPRFKG

SEQ ID NO: 43830 - protein, 389 aa, Streptomyces griseus
  subsp. griseus
  strain JCM 4626 / NBRC 13350
MAAGAGQPGPAASAAPRAAASLERVTAFGANPGNLAMYVYRPAGLPAGAPVVVALHGCTQSARVYSDNAGLDTFADRHGFLVVYAETTAANNANTCFNWFQPGDTRRGQGEAASIRQMVAHAASAYGADGRVHVTGLSAGGAMTSVMLAAYPDVFAAGAVVAGIPQGCGVDVVTAFGCMSPGVDRTPAAWAQAVRDAYPGHTGPWPRVSIWHGDRDATVVPRNADELRDQWTAVHGLGQSPDRTSTIGPNGTRRSMYLSAGGASVVEVNRVPGIAHGTPVDPGGGGEQCGATGTQHFIDSICSSHWITRFFGLDGGTTPEPPVDPPTEPAACWTASNYEHVRAGRATTTGGQVYAKGSAQHLGLYNTFVTHTLKESPAGHYVLADSTCP

SEQ ID NO: 43831 - protein, 454 aa, Streptomyces griseus
  subsp. griseus
  strain JCM 4626 / NBRC 13350
MLAAWTAALSAASPLPPDAGRPGHCSRPDTIEVPGAAHQQAACLAELTTAGTVASGHTDPADWAGLTPKDLATPRGVPGLQIDGYFPDSSTGNTNHGWNHDSQFVIRLPDRWNGGLVVAGSPGVREQYANDRAFGDWALARGYAYAATDKGNTSAAFHRDGAAPADAIAEWNTRVTQLTRAARRVVAQRYHRPPSRTLAMGLSNGGYLVRWQLENHPGLYDGGVDWEGALWRSEGPNLLTFLPPALRAYPRYAAGGADAGAAHRTMTAAGYPAGSEFLWPYHHQYYWDLTQRIYREEIDPEFDGSTEAGTPFCAPGTPACDADYAYAERPAQVREAVERIALTGRIGKPLISFHGTLDVLLPISQTSDAYARLVRREGRGALHRYYRVEGGTHVDSLVDTFPDRLRPLVPCHRSAAAALERWLDDGRRPPSSRTLELPEGAGPAELLARCPLDG

SEQ ID NO: 43832 - protein, 752 aa, Streptomyces griseus
  subsp. griseus
  strain JCM 4626 / NBRC 13350
MGLALLAQPAQAQPNSPSAATASNASQPSRPAGSADLAPQAQQSPTSDPGHQAEGRSKASQLPPLSADKSPLKEAHGEHDAPSEQGADGKSRAKAAAACDPADFTGRTGSELVRFIRASTTDCVNTLFSLTGSSARLAFREAQMTSVAYALRDNAAYYPGDGSTGTPQLVLYLRAGYYVQWYNPDVVGPYGPTLRTAIRSGLDAFFASPRSRDVTDDNGETLSEAVILIDSAQENARYISVVKRMLADYDSTWNAFSRMLAAVNNVYTVTFRGHQVPAFVSAVEADPSLIDALHRFAADHLSLLEGDQSYLTSNAGRELGRFLQHAGLRSKVRPLATALLRDTSLTGPTAPLWVGIAEMADYYDKANCAAYGVCDLQERLKREVLPVRHTCSPSIRILAQQMTSAELNASCTSLIEQDAYFHRIAKDSGPVADDNNTTIEVIAYDSSTDYQTYAGAMYGIDTNNGGMYLEGDPSAAGNQPRFIAYEAEWLRPDFHIWNLNHEYTHYLDGRFTMYGDFAANMTTPTIWWVEGFAEYISYHYRQEPYTAAMTEAGKGTYALSTLFSTDYSHDTTRVYRWGYLAVRYMLEKHPADMDKVLAHYRAGQWSAARTYLTTTVGTRYDSDWRTWLAGCAAGDCGGGDGAVTECADSDPRVLGQNCRRSNLSATTGNYSYHYLYVPAGTKQLKITVSGGTGDADLYYSGSGWATTGSSTQRATGAGNSHTLTISNPRSGANYISLHAVASFGGATVTTAY

SEQ ID NO: 43833 - protein, 355 aa, Streptomyces griseus; identical to SEQ ID NO: 43809
  subsp. griseus
  strain JCM 4626 / NBRC 13350

SEQ ID NO: 43834 - protein, 217 aa, Streptomyces griseus
  subsp. griseus
  strain JCM 4626 / NBRC 13350
MRHLRTAVATAAAGLGLVAALGTAPVVAAAPAPAAPSSTTVAAYNGSGENAAANRAFLDAVMKSVAEKRAANPGIKAVTVTYDASGAPSFSGEIANSTRIWNSSVSNVQLQEGSGADFTYREGNDPRGSYASTDGHGRGYIFLDYAQNQQYDSTRVTTHETGHVLGLPDNYSGPCSELMSGGGPGPSCTNSQPDANERARVNQLWQNGLAALARSAS

SEQ ID NO: 43835 - protein, 299 aa, Streptomyces griseus; identical to SEQ ID NO: 43802
  subsp. griseus
  strain JCM 4626 / NBRC 13350

SEQ ID NO: 43836 - protein, 392 aa, Streptomyces griseus; identical to SEQ ID NO: 43805
  subsp. griseus
  strain JCM 4626 / NBRC 13350

SEQ ID NO: 43837 - protein, 785 aa, Streptomyces griseus
  subsp. griseus
  strain JCM 4626 / NBRC 13350
MLSPTRARATLLAAGAAVAGLLMTSLAATPSAAATDHESCRPDGLYKTPGADTAYCTVYDGEGREKMGADHKRRVIGYFTNWRTGKDGKDAYLVPNIPWDKVTHLNYAFAHVDSSNKLSVGPDSADNASTGMTWPGVAGAEMDPTLPYKGHFNLLTKYKKQHPDVKTLVSVGGWAETGGYFGPDGKRVNSGGFYSMATNADGSVNQTGINTFADSAVTFIKKYGFNGVDIDYEYATSMKDAGNPMDHTLANGRRAGLVKGYDALMKTLREKLDRAGAADGKHYLLTVAAPSSGYLLRGMETYQMQKYLDYVNIMSYDLHGAWNEYVGPNAQLFDDGKDNELAQAGVYTTSQYGGVGYLNTDWAYHYFRGSMPAGRINIGLPYYTRGFKNVQGGTDGLWGKAATTTCPAGAGLTKCGDGAVGIDNLWHDKDDNGKESPAGSNPMWHAKNLEKGIAGDYLASYGFPANTQLTGTYVRKYDSTLVAPWLWNAQKKVFLSTEDEQSVKAKADYVVDKGIGGTMIWELAGDYRWNATKGQYETGDTLTTAMYDAFKSAAPYGAKRSTVTLPTEAVNIDVSFNQFALGDSNYPISPKLKITNRTQATLPGGTEFQFDYSTSAPANAKDQSGFGTSIVRSDHTAANNVGGLKGPYNRVSLKLPAWQTLAPGASVELDFVYYLPTSTPSNWTVTFGGKSYSLTGDLARGTTVVEPGTGTNPTPTPTPTGPTPTPTPTQPGGSCTAPAWNAATEYGGGSTVSHGGHQWKASWWTKGETPGSAGQWGAWKDLGAC

SEQ ID NO: 43838 - protein, 412 aa, Streptomyces griseus
  subsp. griseus
  strain JCM 4626 / NBRC 13350
MRHSRHSRISSKYRFVFVAAALSASVVLGTQATAQARDAAPAGDSSAPLYQPEMVRALAASLGVDERTATDRLDRQDAQQKRLAELRAGGLVDDGAFFDASGDLTVNAENRADAARFERAGLDARLPARGESTLDRIKARLDASAAKSAPAGVVAWSVDLAADQVVVKVNSDRSAPAKAFLAAAAKHGSAVRIVRGEEKLAPQAAIYPGSKMTINNTTGWCSVGYGARDRSGNQYLVTAGHCVANLPTLRYDGTAFAKGTKTRYALGTRSVDMGIASVNSGHSITTSVGTWGNTNPIAVRGSSRAASGASLCKSGATTGWTCGTVGSYNVSVTYVDLNGGPDTVVTGLATSSVCTEGGDSGGAYISGNQAQGMTSGGPTNQRCTGGVNSRGSSYFQPLDDTLAHYGLTLNTN

SEQ ID NO: 43839 - protein, 446 aa, Streptomyces griseus XylebKG-1
MEYVDPSHPAPPGAPPPRTERGGRWSRAVRRLGAVVALVTGAALVGPGTAGAAPAGPMAAGAGQTGPAASAAPRAAASLERVTAFGANPGNLAMYVYRPAGLPAGAPVVVALHGCTQSARVYSDNAGLDTFADRHGFLVVYAETTAANNANTCFNWFQPGDTRRGQGEAASIRQMVAHAASAYGADGRVHVTGLSAGGAMTSVMLAAYPDVFAAGAVVAGIPHGCGVDVVTAFGCMSPGVDRTPAAWAQAVRDAYPGHTGPWPRVSIWHGDSDATVVPRNADELRDQWTAVHGLGQSPDRTSTIGPNGTRRSAYLSAGGTSVVEVNRVPGIAHGTPVDPGGGGEQCGATGTQHFIDSICSSHWITRFFGLDGGTTPEPPVDPPTEPAACWTASNYEHVRAGRATTTGGQVYAKGSAQHLGLYNTFVTHALRESPAGHYVLADSTCP

SEQ ID NO: 43840 - protein, 785 aa, Streptomyces griseus XylebKG-1
MLSPTRARATLLAAGAAVAGLLMTSLAATPSAAATDHETCRPDGLYKTPGVDTPYCTVYDGEGREKMGADHKRRVIGYFTNWRTGKDGKDAYLVPNIPWDKVTHLNYAFAHVDSSNKLSVGPDSADNASTGMTWPGVAGAEMDPTLPYKGHFNLLTKYKKQHPDVKTLVSVGGWAETGGYFGPDGKRVNSGGFYSMATNADGSVNQAGINTFADSAVTFIKKYGFNGVDIDYEYATSMKDAGNPMDHTLANGRRAGLVKGYDALMKTLREKLDRAGAADGKHYLLTVAAPSSGYLLRGMETYQMQKYLDYVNIMSYDLHGAWNEYVGPNAQLFDDGKDNELAQAGVYTTSQYGGVGYLNTDWAYHYFRGSMPAGRINIGLPYYTRGFKNVQGGTDGLWGKAATTTCPAGAGLTKCGDGAVGIDNLWHDKDDNGKESPAGSNPMWHAKNLEKGIAGDYLASYGFPANTQLTGTYVRKYDSTLVAPWLWNAQKKVFLSTEDEQSVKAKADYVVDKGIGGTMIWELAGDYRWNATKGQYETGDTLTTAMYDAFKSAAPYGAKRSTVTLPTEAVNIDVSFNQFALGDSNYPISPKLKITNRTQATLPGGTEFQFDYSTSAPANAKDQSGFGTSIVRSDHTAANNVGGLKGPYNRVSLKLPAWQTLAPGASVELDFVYYLPTSTPSNWTVTFGGKSYSLAGDLARGTTVVEPGTGTNPTPTPTPTGPTPTPTPTQPGGSCTAPAWNAATEYGGGSTVSHGGHQWKASWWTKGETPGSAGQWGAWKDLGAC

SEQ ID NO: 43841 - protein, 192 aa, Streptomyces griseus XylebKG-1
MLESRWLKAVGVAAAITLAAATAAQAAPAAEPAAEDASAVVTLRYDDSRAGGWEAQIAAGVASWNSNVDNVKLVEAAPGTRAEIQIVATSGWPQATLGPVRPGGQVRVELGSQAVAQGHDKTRIAAHEIGHSLGLPDTKPGPCSQLMSGSSAGTSCKNAVPNAAEQSRVESAYAGGLASRVPADGRVLVDAP

SEQ ID NO: 43842 - protein, 805 aa, Streptomyces griseus XylebKG-1
MTSAWSRRTFLATSAAFTAAGGGALMLAAPGTAASAAPENDAYAALRTTWSALILGEGFSPTAEPFRSRLADLGAKASRLLETMAPAEGSLWPDAVFADPDPDTDAESYVLSGRMADSFVRLNTMAQAYRQQGTGLTGNTALRDAVLTGLEHLSTQVYNDGQSRYGNWYSWQIGAPQALLDVCVLMYDAIAQERLARYCAAVDHFVPDSAVASYTGTSTGANRVDLCRVLALRGVVGGKAAKIALARDALSPVFPLVTRGDGLYADGSFIQHTTVPYTGSYGSVMLGGLGLLFALLKGTTWEVTDPKRQVVFDAVENAWAPFLYNGLVMDSVAGRAISRGEVDDHRRGHPIMASIVLLGRGASAAENARWRGLVKGWAQRDYYSPPLSNPSLGLTALARLKSVLDDTSLTPVAEPAGHRLFPDMARATHRRPGWAASLSMADRRVTYYEAGNGENLRGWHTGSGMLYWWGDTFANGQYSDAFWPTVDPYRLPGTTASRKVLADGAGGDWGVSLPDVNWVGGVTDSKRAAVGQYLKGLTSTLMAKKSWFFLDDTVVCLGAGIQGRDGAAVETTVDNRNLGPTGNAPFTVDGSVKPLTLPWSATLTGASWAHLAGHGGYVFPGGATVKALREDRTGRWRDINKAGSTDPVSRKYLTLWFDHGQDPTDATYAYQLLPGASPQRTAARAADSGWLRVLANTDAQQGVSVPSLRLTAVNFWFGGTVGPLVADAPCSVMVTEHADGTATVCVSDPMRARTNLTLTWNRAVASVVSKPATVTSAATGASLRLVFGDLSGTRGATQTVKVRLS

SEQ ID NO: 43843 - protein, 297 aa, Streptomyces griseus XylebKG-1; identical to SEQ ID NO: 43801

SEQ ID NO: 43844 - protein, 457 aa, Streptomyces griseus XylebKG-1; identical to SEQ ID NO: 43820

SEQ ID NO: 43845 - protein, 287 aa, Streptomyces griseus XylebKG-1; identical to SEQ ID NO: 43821

SEQ ID NO: 43846 - protein, 773 aa, Streptomyces griseus XylebKG-1
MRTTLVRRGVGAVLPLALAGAMGLALLAQPAQAQPNSPSAATASNASQPSRPAGSADLAPQAQQSPTSDPGHQAEGRSKASQLPPLSADKSPLKEAYGEHDAPSEQGADGKSRAKAAAACDPADFTGRTGSELVRFIRASTTDCVNTLFSLTGSSARLAFREAQMTSVAYALRDNAAYYPGDGSTGTPQLVLYLRAGYYVQWYNPDVVGPYGPTLRTAIRSGLDAFFASPRSRDVTDDNGETLSEAVILIDSAQENARYISVVKRMLADYDSTWNAFSRMLAAVNNVYTVTFRGHQVPAFVSAVESDPSLIDALHRFAADHLSLLEGDQAYLTSNAGRELGRFLQHTSLRGKVRPLATALLRDTSLTGPTAPLWVGIAEMADYYDKANCAAYGVCDLQERLKREVLPVRHTCSPSIRILAQQMTSAELNASCTSLIEQDAYFHRIAKDSGPVADDNNTTIEVIAYDSSTDYQTYAGAMYGIDTNNGGMYLEGDPSAAGNQPRFIAYEAEWLRPDFHIWNLNHEYTHYLDGRFTMYGDFAANMTTPTIWWVEGFAEYISYHYRQEPYTAAMTEAGKGTYALSTLFSTDYSHDTTRVYRWGYLAVRYMLEKHPADMDKVLAHYRAGQWSAARTYLTTTVGTRYDSDWRTWLAGCAAGDCGGGDGAVTECADSDPRVLGQNCRRSNLSATTGNYSYHYLYVPAGTKQLKITVSGGTGDADLYYSGSGWATTGSSTQRATGAGNSHTLTISNPRSGANYISLHAVASFGGATVTTAY

SEQ ID NO: 43847 - protein, 147 aa, Streptomyces griseus XylebKG-1; identical to SEQ ID NO: 43808

SEQ ID NO: 43848 - protein, 412 aa, Streptomyces griseus XylebKG-1
MRHSRHSRSSSKYRFVFVAAALSASVVLGTQATAQARDAAPAGDASAPLYQPEMVRALAASLGVDEKTATDRLDRQDAQQKRLADLRKGGLVDDGAFFDASGDLTVNAGNRADAARFERAGLDARLPARGESTLDRIKARLDASAAKSAPAGVVAWSVDLAADQVVVKVNSDRSAPAKAFLAAAAKHGSAVRIVRGEEKLAPQAAIYPGSKMTINNTTGWCSVGYGARDRSGNQYLVTAGHCVANLPTLRYDGTAFAKGTKTRYALGTRSVDMGIASVNSGHSITTSVGTWGNTNPIAVRGSSRAASGASLCKSGATTGWTCGTVGSYNVSVTYVDLNGGPDTVVTGLATSSVCTEGGDSGGAYISGNQAQGMTSGGPTNQRCTGGVNSRGSSYFQPLDDTLAHYGLTLNTN

SEQ ID NO: 43849 - protein, 218 aa, Streptomyces griseus XylebKG-1
MRHLPTALASAVAGLGLVTALGSAPAVSAAPAPATSTPASIAAYNGSGENAAANRAFFDAVMKSVAEKRAANPGAQAVTVTYSAASAPSFRTQIANSTRIWNSSVSNVRLQEGSRADFTYREGNDPRGSYASTNGHGRGFIFLDYRQNQQYNSTRVTTHETGHVLGLPDNYSGPCSQLMSGGGPGPSCTNAQPDANERARVNQLWQNGFAAASVPAGS

SEQ ID NO: 43850 - protein, 117 aa, Streptomyces griseus XylebKG-1
MGFLDNLKAKLGPAKDKVGDLAQQHGGKIEQGLDKAARTVDQKTKGKYSDKIDSGTRKAKEAVDKLGNKDGGAPGAPGAPGASGTPGTPGTPGAPGAPGTPGASGTPGNTPPPPPAS

SEQ ID NO: 43851 - protein, 406 aa, Streptomyces griseus XylebKG-1
MKHGKKNARRYIVAASIGALLSAGVATGAYAGTTEEPSAPAAAPAYQPEMVKALATTLGVSEKAAVARLDREADQQGRFAELRKDRVDTLGSFFAEDGSLVVNAADAGAAEDVRAAGLRARVPERGESELDRIKARLDAKALKSAPAGVSAWSVDLASDTVTVEVNGDSDAATRSFLEAARSNGDAVRVVKGQEKLETQAVVPPGSRMTFNGYLCSVGYGAKDRNGKQVLVTAGHCIEDLPALAYNGTRFAKGTHTRFALGTRSVDMGIATVDAGNSIGLDVTTYGRAGTVPVKGSKRAPSGAALCKSGQTTQWTCGKVGSYNVSVTYTDQNGGPDTVVTGLASSSVCTQGGDSGGAYISGDQAQGMTSGGPTNQRCNGQVNSPGSSYFQPLDDALAYYGLTLNTK

SEQ ID NO: 43852 - protein, 434 aa, Streptomyces griseus XylebKG-1
MAPKAVEPTVIQSVTARRILDSRGNPTVEADVRLADGSLGRAAVPSGASTGAREALELRDGDAGQWHGKGVDRAVAHVNGEIAAAVVGRDADDQAGLDAALVALDGTPDKSRLGANAILGVSLAAAKAAAAAHRRPLYRYLGGADARLLPLPMMNIVNGGAHADNPLDFQEFMIAPVGARTFAEAVRMGSEIFHTLRGDLLAAGHATAVGDEGGFAPALRTAEEALDFVMSAVERSGYRPGADIGLIMDPASSEFFRDGAYAYAGEGVRRTPSEQVDYLVGLIDAYPIVSVEDPMAEDDLDGWRELTARVGGRCQLTGDDVFCTDEEQVRQGIRTGVGNSVLVKVNQIGTLTEALATVATARRAGWSAVMSHRSGETEDTTIADLAVATGCGQIKTGSLSRSDRTAKYNRLLRIEEELGGSARYAGGELLSRSR

SEQ ID NO: 43853 - protein, 391 aa, Streptomyces griseus XylebKG-1
MPPAPPRQSPARGASRRPAERRRTLVANPESLRRLVPKALVVAFLAGGTTAFVAHDKAVRLNVDGTPRTLHTFADDVTGLLAEEGVTVGAHDVVTPAPGTALGHGDAVVVDHGRPVTLTLDGVRRQVWTTADTVAGALRAFGIRAEGAHLSAPRSTRIARTGLTLTVRTERTVTFMADGQERTLRTNAATVHEALAEAGITLHGQDTTSVAPTSFPRDGQTVSVMRITDTREVHEETVPYAVERSEDPALFRGTEVIERAGRNGVRRVTYAVRTVNGVRQRPRRTAEELVHPPVSRVVRTGTRPRPATVAGADGLNWSALAACESGGRPGAVDASGTYGGLYRLDTQTWQSLGGSGRPQDAPAAEQTHRAKKLYVQRGASPWPHCGRRLTG

SEQ ID NO: 43854 - protein, 450 aa, Streptomyces griseus XylebKG-1
MAANGRHRRYQPSRINRASLTVTASGAGIALPLITAASAGAAPVEVWEKVAACESSGDWSVNTGNGYYGGLQFSGSTWAAYGGTQYAPRADLATRDQQIAIAEKVLDGQGPGAWPTCSVPAGLTRGGDAPGAAPDSGPDTQSAGRSTVRAAAPQSAPPRQPRTRPVETTPTHVPGKRDSYTVASGDSLSGIASAQRVRGGWQGLYAANRTVVGADPDLIFPGQRLSLDQSRAPKAGEGKKSAQPERKATPKPPAATAEARKADRPRAAPKKEAPAQAAPKKEAPKQQAPEKAAPKQQAPKKEAPAKERSAPERAVKHSGFSAPVSAGTGTPYRQAGGWSSGYHTGVDFPVPTGTSVKSVAPGRVVSAGWAGAYGYEVVIRHNDGKYSQYAHLSALHVRAGQSVSGGQRIARSGSTGNSTGPHLHFEIRTGPGYGSDVDPLAYLRAGGVRV

SEQ ID NO: 43855 - protein, 380 aa, Streptomyces griseus XylebKG-1
MRHATLLRTGLSALLVIGAWTAAGPVSASAEPTPAEPPASAALLSAMQRDLGLTEKQALTRLADEKAATALEKKAQRAAGSAFGGSWLDAKSGKLTVAVTTAEKAEAVRATGAGTRLVEHSAKSLDAAKARIDALKAPSGVSSWHVDPATSRVVVNVVAAEQTDNDVRSFVTKARKAGPVTVRTTAEAPQTFAAGTVGGDPYYTGNVRCSIGFSVHGGFVTAGHCGGTGQQVRGWDNSYIGNFQGSSFPGDDYAWVNVGSGWWTVPVVLGWGTVPDQLVRGSNEAPIGASICRSGSTTRWHCGRVLAKNETVNYSQGAVHQMTKTSVCAQGGDSGGSFISGDQAQGVTSGGWGNCTSGGETWYQPINEILNRYGLRLHTA

SEQ ID NO: 43856 - protein, 341 aa, Streptomyces griseus XylebKG-1
MGSANGRHRRPRQAPAIVVAAGVTGSAIAIPLLGAGGAQAAEATTWDRVAECESGGMWSADLGNGYYGGLQFSQETWSAYGGTAFAPRADLASRSQQISVAEKVLDDQGPKAWPSCAVISGLAVDGGLPGVDPGASPSADPSADPSADPEPTPTDEADATGESGESGKGAKGDEADNGGTGGAEKGSRSPDSSVKPSAPPASDASDPSTAPGASAGESGKGGKHRGAPAPEGADAGQEDGLRESGRHASRGDSGARDGGAAADGGYTVRPGDNLWAIADVQEVPGGWTGLYETNKDLLGSDPDLILPGQNLDLGLDRDAGGSADPAAGEGVETPAGAPAAN

SEQ ID NO: 43857 - protein, 232 aa, Streptomyces griseus XylebKG-1
MLLNSKGKHRRPSKAVRIATLAGVTGAAVAVPLMGATGASAASVETWDAVAQCESGGNWSINTGNGYYGGLQFSQSSWAAAGGTQYASRADLASKDQQIATAEKLLDMQGPGAWACAGAGGLTNDGVDPGVNTGSGESKPEQAQPERQAEQPTTRSEQREAPKAESGKTVTTPTGQKVQKGDGEYKVKAGDTLSTIAKAEGVKGGWSKIFKLNDDIVKDADLIFPGQQLHLK

SEQ ID NO: 43858 - protein, 426 aa, Streptomyces griseus XylebKG-1; identical to SEQ ID NO: 43829

SEQ ID NO: 43859 - protein, 355 aa, Streptomyces griseus XylebKG-1
MRRNSRARLGVSLLLVAGALGLGAAPSTAADTPPAAPSAIPAPSAYALDAAVERQLGAATAGTYLDAKTGGLVVTVTTDRAEEQARAAGATVRRVARSAAQLDAAMATLEAEAKITGTSWGVDPRTNRVAVEADSSVSARDMARLEAVAERLGGAVDIKRVPGVFHREVLGGGAIYGGGSRCSAAFNVTKGGARYFVTAGHCTNISANWSASSGGSVVGVREGTSFPTNDYGIVRYTDGSSPAGTVDLYNGSTQDISSAANAVVGQAIKKSGSTTKVTSGTVTAVNVTVNYGDGPVYNMVRTTACSAGGDSGGAHFAGSVALGIHSGSSGCSGTAGSAIHQPVTEALSAYGVTVY

SEQ ID NO: 43860 - protein, 299 aa, Streptomyces griseus XylebKG-1; identical to SEQ ID NO: 43802

SEQ ID NO: 43861 - protein, 361 aa, Streptomyces griseus XylebKG-1
MKHRRISRKRATLAGSAVVALVAAGFTFQTANASDDVPAFGAKTLSADAAGKLATTLDRDLGADAAGSYYDATAKTLVVNVVDEAGAEQVRQAGGKARIVENSLAELKSARGTLTEKATIPGTSWAVDPVSNKVLVTADSTVDGAAWKKLSAVVEGLGGKAELNRTAGEFTPLIAGGDAIWGSGSRCSLGFNVVKGGEPYFLTAGHCTESVTSWSDTQGGSEIGANEGSSFPENDYGLVKYTSDTAHPSEVNLYDGSTQAITQAGDATVGQAVTRSGSTTQVHDGEVTALDATVNYGNGDIVNGLIQTTVCAEPGDSGGALFAGDTALGLTSGGSGDCSSGGTTFFQPVPEALAAYGAEIG

SEQ ID NO: 43862 - protein, 294 aa, Streptomyces griseus XylebKG-1; identical to SEQ ID NO: 43800

SEQ ID NO: 43863 - protein, 273 aa, Streptomyces griseus XylebKG-1; identical to SEQ ID NO: 43813

SEQ ID NO: 43864 - protein, 326 aa, Streptomyces griseus XylebKG-1
MPNTAFRRLTGVALSAALATATLAVSAPPAAAAETPSLRVLSYNAFIFSKTLYPNWGQDHRAAEIPKTSFFRGNDVVVIQEAFDNGASDALLRNSASPYPYQTPVVGRSKSGWDATGGSYAAATPEDGGVTILSRWPIVRKEQFVFKDACGGDWFSNKGFAYTVLNVNGARVHVVGTHAQSTDPGCSAGQAAQVRSRQFKQLDAFLDAKNIPASEQVVVAGDFNVDGHAAEYASFLADAGLSAPETRTGHPYSFDTRDNSIAAERYPDDPREDLDHVLHRTGHARPAGWKNEVIKEESAPWTVSSWGKDYTYTNLSDHYPVIGSGR

SEQ ID NO: 43865 - protein, 215 aa, Streptomyces griseus XylebKG-1
MRHLRTAVATAGLGLVAALGTAPVVAAAPAPAAPSSTTVAAYNGSGENAAANRAFLDAVMKSVAEKRAANPGIKAVTVTYDASGAPSFRGEIANSTRIWNSSVSNVQLQEGSGADFTYREGNDPRGSYASTDGHGRGYIFLDYAQNQQYDSTRVTTHETGHVLGLPDNYSGPCSELMSGGGPGPSCTNSQPDANERARVNQLWQNGLAALARSAS

SEQ ID NO: 43866 - protein, 393 aa, Streptomyces himastatinicus ATCC 53653
KTTDVKTFSSPSAVKLARSLASDLGDNGAGWYFNNDTSQLVMNVMTEDAAKTVEAQGAVAKIVQNSMSELKAATKTLSTDASWAGTAWSIDPVTNKVRVTADKTVTGTKWATLTKATDAMDGMVSVQRTKGEFKRFDEGDTAQPGANGGAAGAGDAAGDAAGDDAAAGGAGDAGAGDAGAGGAAAGGAGEAAGGAGEAAGGAGGGGEAAAGLVGGDAIFGGGARCSLGFNVSVDGAPGFLTAGHCGNESETWTADQAGAQALGTVQDTQFPETDFALVMYDDAATQPESAVKLADGSNQAIGRAVEASVGLKVQRSGSTTGVSDGEVTGLNATVNYGGGDIVNGLIQTNVCAEPGDSGGAMFAEDAAVGLTSGGSGDCTQGGETFFQPVTGAL

SEQ ID NO: 43867 - protein, 408 aa, Streptomyces himastatinicus ATCC 53653
MAPGTVGALMSGGAMYDDSPDGLLALANSIAGLVGAPVTIEDDASELITYSPGQEYSDDARVATILSRRVPDRYRPLLRNDRLDVRLAGSSVPLYADFRASGAAPDVLPRAIMPIRVDDLSVGSIWAIVPTAPSREQRAALEEAAALAAPVLARQIARRRGEEARRAAAVRALLGGGAGAVEAAAELPLAPGPLAVVALRPLSPAPSGEPLRRALAGLDALAGPALGGVHAEADGAGYAVLPVRDEQRLARVVRELQDRSGLVAGVGRTVPGPDTLDRSRADADLVVRLLTRLGGVGGAAAHIRDVHLDALLMQTVDLADEAGHDPLGAIAELERYDRERGTDLLDSLARYLATGEDARLAARQLHVHPNTLRYRLRRAHEIAGLDLTDPAAKFEIQLRLRLRALRLP

SEQ ID NO: 43868 - protein, 840 aa, Streptomyces himastatinicus ATCC 53653
MIKPGEIPQYTGNLELLEKAHGNLKTDAGHIRDTGADVHTHFQGLSAYYKAPEAERLFATTKPVKDRADTFADDLGKVSSALSEYATEIRPLVTKLTQLKTDATQFVNDNKDDDDWEYDEDKVDEHNQLRDDITATVAAFWAAERTCHNKITALFGGTQMVAGDGSKAKNQYGFNADDLKNAKLPWGDPVEEKHHAWEVGHWVKSFVWDGVIVDGVWGTIKGLGTLVGCGGWDAMGQAWKGLAQLGTGLAISAVPGAREAFWGLPDDKLPSWLRDSRTAMKETGKALVAWDEWGKNPGRAAGAVTFNVVTTVFTGGAGGAAAGAGKAGAVAKALSVAGKAGRVIDPMTYVAKGAGAGLSKIGDITKGLKGIGKVDVPHLPDGAVELPNGSLLEPNGNLVPPPPGSVDVAPAAHGTGHGASGLPESWQIQQPGAPFPAGAHAPGGSFDHVPGGHTNPGGHVPTGGPAHAPGSYGPAPTSLDNAAGGNAGHVPGGGHGSSTPWYHQTPSNHVPGAPAGHVPGEVGSHVPGQAGPPHVPAHDVPGTGHPHTADAPHGPGHDAPGAHGHDGAHGGHGDDAVGHGDDATHAGDHVDDVAGAAAHHGTDAPVAPGHGGTDVPGSGAAEPFEYKPHMSDHEFARLSTDAERHAVAQAELADGTNLGPSATDEAGKAYGNAHWNDFLDQLDPEAKGALEKYSSFYYKSINGPLRQGAALDGNIQRLVDNMDRVMGARRVPENVMVVRGTDVSYLDLRSPLELQGSVWDDLGYTSTSLGKTAAFGHMPVIMHLRVPKGTPALWIDHISSNKGERELLLARGTEYKVTRVFKDGGGQWQVYGEVLPRAKP

SEQ ID NO: 43869 - protein, 267 aa, Streptomyces himastatinicus ATCC 53653
MQLSHYDPQTPASYAMSYARASVDDALCGYGWARTDDSGTPVPYRRSELAAAFGTSPGRAPAPGVLIDENAPGGPVADSKSRGADGRHEYNLRGERCVYRLAYPQRGSTGAERTWAARLAAGLDATRRSGDLHGKPALIVHGRDDTRVPVNHSSRPYLGLNARAQQGNSTVGYVEVTHAHHSDAQTPGLDNRYVPLGYYYQQALDVMWQRLRGRGGELPPSQVVRTVPRGGEPGHAPELTRANVPAIAADPAAGDRVRVVRGTVRVP

SEQ ID NO: 43870 - protein, 540 aa, Streptomyces himastatinicus ATCC 53653
MSPGACGAYKLFGVRAGGACLWQGLRRDHRRRGPVMRVRGRHGMAAMREGGLRSVNSLVSALKEFRCLTDPDSRALCLDLVAMEMETTSVPVRGHRVTDYFLVELARECLENVRMMRALRASLAVLAPDTDAMEHLDSVVEQMTARPVLPAPAAGGLRSLLEDLEFGNLGQLCRAAAGPLQEVPAVTGPWHAFEELSRMNARPDGLPPGLALVEYLAASAQPLRRADALRAWADEQARELDLTSQLRSLRQQEWHAAPAEPDDAYLVIRLLPQEEPGRYELSSWHQYDPSGWHPARGPVTQVTAATAERAVQELVFAAEEEWKDARCIHLEFLLGPDDLNLPVHLWRKELDSTMATPLCMDYPVVVRSLERSQTRRWHRPWNQRWQIFTGRPELARELVVEGQDPDSPRSGDPAALLARLQADPHVVALILNSPPGGAGEGAYEALAAWRAGIPLVAWDRRPSRDPALVQHLRQKSDEASGDLARLREAVTKLRLDAHTIDSAEREHHPGQHVVLVWDDPTRPVETQGRMTGPDEGLGSR

SEQ ID NO: 43871 - protein, 180 aa, Streptomyces himastatinicus ATCC 53653
MTSSRLVRALPVAIAAVLALAGGQAVAAPAPDAAARVVTYDASGAAEFKDAVTKGAAVWNQSVKNVQLKPVTSGQRANLRVVADNGWPRAQVTALGSGTIYFGRQAVDEGHNTVRIASHEMGHILGLPDVKPGPCSSLMSGASAGTSCTNANPNAAEKAEVEDAFALLESSAATTAAYKD

SEQ ID NO: 43872 - protein, 795 aa, Streptomyces himastatinicus ATCC 53653
MPPRPLRPWSRRGFLAAAATGALSPALAGPPAHAAGPDFDALRRRWTDLTLGTGFDPAAEPYAARLAETGRLATGFRTSMAPAAASLWPDQPFDPPAGITQSYQRLNTMAHAYAQPGTGLTGDPGLAEDIARGIDHLDATVYSPATTRYGNWWEWQIGSPRLLLDTLAILYDRLGEERRARCLAAVDHFVPDTMLGDYTGTSTGANRVDLCRVVALRGILGAAPAKVALARDALSPVFPYVTKGDGLYADGSFIQHTWVAYSGTYGYVLLDGLGRLFALLAGSEWEVTDPNRRIILDSVEHAYAPLLHDGLMMDVVSGRAVSRGVQVNDPRGIMQSDHQRGHLFLAAIALLGTGADDATRERWNGMVRGWIARDTSNPVLTDPQFGVADLARLAAVAKGPGPALPEPIGHRLFPAMDRAVHRRPGWTAALAMASDRIAYYENGNGEHPRGWHTGAGMLSWWAGEGTAGQYTDAFWPTVDPYRLPGTTASARPLADNEGGGWGEPKPAARWVGGTTDGEYAAIGQDVRGLGSTLRAKKSWFCVADAIVCLGADITARDGAPVVTVVDNRNLGADGTPTLTVDGVPQPAAPERTRTFRRARWAHLAGHGGYVFPGGAALHTRREARTGSWRDINTGSSPDLLTRRYLTLWHDHGTDPDGGGYAYLLMPGAGPAALAARAADRRWLTVLANSRARQAIAIPSLGVTAANFWAPGTAGPLTAGAPASVLLRRTGRHTAHLAIAEPLRTGEPFDVLWTHPVRAVTAHDATVEVLATGGTLRLRITPGTACATHHCVVALR

SEQ ID NO: 43873 - protein, 301 aa, Streptomyces himastatinicus ATCC 53653
MRIKRTTPHGSRARRIALLAATSALVAGTALVAPAAYAGNDAARTFTAAEAKAAGDAVLDADVAGTAWYVDKATNSLVVTADSTVSQSEIAKIKDAAGTNADAIEIKRTPGKINKLISGGDAIYASSWRCSLGFNVRNSSGANYFVTAGHCTDGAGTWWSNSGKTTTIGPTSGSSFPTNDYGLVRYSGSVTPQGAVGSQDITSAANPTVGQTVTRRGSTTGTHSGRVTALNATVNYGGGDIVYGMIQTTVCAEPGDSGGPLYAGSTALGLTSGGSGNCTSGGTTFFQPVVEALNAYGVSVY

SEQ ID NO: 43874 - protein, 401 aa, Streptomyces himastatinicus ATCC 53653
MGILGGAIWHGRAPARAGAPRAVRPPGRAPHCQRPNPPLEDRELKHRRIPKRRAALAGAGVMALAAAALTLQNANAAPTEPQAQTLSVNSAGKLANTLTSALKSDAVGSYYDAKAKKLVVNVVNKAAAERVRDAGAEAKVVEHTLAQLKQARTTLKDKATIPGTSWSVDPRANKVVVTADSSVKGARMATLNKVAESLGDKVEVKRSAGKFSTFLAGGDAIWGGGGRCSLGFNVVKDGEPYFLTAGHCTESIKSWSDSQGGDEIGANEGSDFPGNDYGLVKYTKDVAHPSEVNLYNGDSQAISKAGEATVGQKVKRSGSTTQVHDGEVTGLDATVNYQEGSVSGLIQTNVCAEPGDSGGALFAGDTALGLTSGGSGDCSSGGETFFQPVPEALEAYGAKIG

SEQ ID NO: 43875 - protein, 133 aa, Streptomyces himastatinicus ATCC 53653
MSAALGLGVSGTAHAEPATPKSLYPPSALVLTVGYGPDDASSVAVQRAVTLSCQPTPTGTHPAPARACAELRAVNGEFSTLTEATESGRMCTKEWRPVTVTAEGIWDGQRVSYEHTFANNCLKNAAVTQLYEF

SEQ ID NO: 43876 - protein, 264 aa, Streptomyces himastatinicus ATCC 53653
MAELRMRRRAIGGALGAIALTAGAITTGLSLSAASAATWPTPSGTPQAVTKTIPVSGTTDGGMKRYYGDGDLGSDNQGEDQPAMFELADGATLKNVIIGAPAADGIHCKGSCTLQNVWWEDVGEDAATFRGTGKTYNVIGGGARKAEDKIFQFNGGGTLNISNFAGQDFSTFVRSCGNCSSQYKRTINVTNTEITAPGKVIGGINTNYGDSLALRKVTIVGDSSKKIVPCQKYIGNNTGKEPSKNGSDADGTYCKYSSSDLTYK

SEQ ID NO: 43877 - protein, 309 aa, Streptomyces himastatinicus ATCC 53653
MRSAARSVIFLRAGRQRLPVRRRLQGVHHPPTPPTEWIHMAPQHHRPRPTRKRALIGGLGAAALTIGAITAGTMLSSASASAEWPTPGDDKPVSSTQKVSGVVDGKMQRYIGEGELGDGGQDEGQPAMFELADGATLKNVVIGSPAADGIHCEGSCTLQNVWWEDVGEDAATFLGGANAKYTIEGGGARKADDKVFQHNGGGTLTIRDFAVQDFGKLYRSCGNCSEQQKRAVVVDGVEVTAPGTSLVGVNENFGDTAKLSNITIIGDSGKKIDPCVRFKGNDTGAEPEETGSGPDGKTCIYKESDISYK

SEQ ID NO: 43878 - protein, 108 aa, Streptomyces himastatinicus ATCC 53653
MAVRGSHRRPASPSRVSPLCAVLTAGSVGIVLPFLNTGAAQAAPVDTWDKVAACESGGNWRINTGNGYYGGLQFSQHTWAAYGGTRYAPRADLATKGQQISVAEAVLR

SEQ ID NO: 43879 - protein, 432 aa, Streptomyces himastatinicus ATCC 53653
MVPSSCSSQAPEEVQTALAPHLDRRCVQHLLVFHQPSPALRDLFVSLHGTAVLASVASDWELPAEKIGELVVLDDPEINTKLYVYTPLADEQRRGILAGRRFGPRPATEAAEDPEPLPITDELIDQMRLSGRRHWLLPICESGDPRLARVLLGKIKLHTLAGQLYLLVRVWERHGAEEVRGLLEETEFPERRSRKHPLPQATHDIVRDALEAADGLAVLRAELDRSRGPAGQVAFLRAHSGTRDLFATALERLAEETGPGLPWAELAREHERDPLADSLLVVLADEDDCPEELRTECGVADLRLQHQAHPHKSTGPRPSPLELVRHHPLPRPHHRRNDWLDKAAGLGMLTPLDVLHEARPAGDAAAYLAYRHHRTRQDGPDPAALAASRKVLELATAHLGEDPEAWALALRLLPDFTGTLPELLTTAAAIVS

SEQ ID NO: 43880 - protein, 418 aa, Streptomyces himastatinicus ATCC 53653
MPLRGRHRRYKPNRISRASLSVTAGGAGIALPLVAAAGANAASSETWDKVAQCESTNNWDINSGNGFYGGLQFTQSTWEAYGGTAYAARADLATRAQQIAVAEKVLDGQGPGAWPVCSGKAGLAQDTGAPQSAPKVVKTVAKERANTAEQVRQSKPTPTSLPGNASTKSGPYVVVGGDTLSRIADTQEVRGGWQALYETNRATVGSDPDLIYPGQKLSLSGGKATPEAEAKPAAKAKTKPAAKPQAKHRAQPKAKAKAQPEAKAKPQHTERRVSKPAAKPAAATGFTAPVSGVSPTTSYRASGSSWSSGHHTGIDFPVGVGTSVKAVAGGQVVSAGWADAYGYEVIIRHADGKYSQYAHLSQLSVRAGQGVNVGQQVGRSGSTGNTTGPHLHFEVRTGPAYGSDINPLSYLRARGISI

SEQ ID NO: 43881 - protein, 219 aa, Streptomyces himastatinicus ATCC 53653
MTLPKLALSATLGLGLAASLAAVPASAATPDHTRSAASAGYVPGAEEKADTDAFIKAVMKSALAKRAKAPSLAAAVTVTYSASSAPTFKSVIARSTQIWNASVSNVKLKEGSNPDFTYREGNDSRGSYASTDGHGGGYIFLDYKQNQQYDSTRVTAHETGHVLGLPDHYSGPCSELMSGGGPGTSCKNSQPNAAEISRVNQLWANGLAALQKKDLAKAH

SEQ ID NO: 43882 - protein, 344 aa, Streptomyces himastatinicus ATCC 53653
MRRVGKHSARGSQEDRDPGSAEAESGPGAGRRRRSAAPGAQDPAVTPSQGIPRTAHGPATPPARSRGGHPGHPGHPGHPGPPGHPGPAGHSGRREQGGGWSAFGTATMNAPQRPGGPAAEPSAGGGPGGGAPGGRPGGLMPGPRKEYLEAFEAPGAPDALEADGEDVFAAGAPGAVPPPRRTRPGAGADDDSKNAADGLDDDTAADGTEPPGKNARGVTKGGKGRTFTGVAAAAVTTVLAVVVAGQVANGPSGDGKAQSKGGPERGDGGAVSSRTDGRATPSASASPELATYGQKMAAPYPLDPKLKGSGAFTTVPGKDKAPGKGQVLRYRVDVEKGLPLDGAL

SEQ ID NO: 43883 - protein, 336 aa, Streptomyces himastatinicus ATCC 53653
MMIVWRRYVQPTNRTPTREAIRMLSGNGRHRRPRQAPAIVVAAGVTGASIALPLFGATGAQAAPASTWDQVAECESAGMWSANEGNGFYGGLQLTLDMWKKYGGTSYAPRPDLASRSQQISVAESILGDRGPDAWPSCALNAGLTDGGDAPDVNPGSTARPSQQDDAEREDRDRSDARDRGDEAGKAPDASDSSDAPERPQDSATPGESEDPDGQGDDAPSPSPTSSAPSSDASDPAPTPSSTEDGSEGSSGRHRGERDAGERPSDHASRGGADRAENPTDGGYTVRPGDNLSAIAEKQELGADWRRLYESNENLIGTDPDLILPGQRLDLTIRGQ

SEQ ID NO: 43884 - protein, 230 aa, Streptomyces himastatinicus ATCC 53653
MRKRTNMSNAQGKHRRPSKATRIAALAGLAGAAVATPLIGATSASAATTSQWDQVAQCESGGNWSINTGNGYYGGLQFSSSTWAAYGGTAFAPTADKAGKAQQIQVAEKVLASQGKGAWPVCGKGLTSGGAPSAPAPSTPSQSQSDSSQSAPSAKPKAAPRSAPEHAARDQARGPIKKGDGEYKVKSGDTLGKIAKAEDVKGGWKKLFELNKNIIEKADMIFPGQQLHLS

SEQ ID NO: 43885 - protein, 426 aa, Streptomyces himastatinicus ATCC 53653
MPSIDVVVAREILDSRGNPTVEVEVGLDDGSTGRAAVPSGASTGAFEALELRDGDKNRYGGKGVEKAVLAVIEQIGPELVGYDATEQRLIDQAMFDLDATPDKSSLGANAILGVSLAVAHAASEASDLPLFRYLGGPNAHLLPVPMMNILNGGSHADSNVDIQEFMIAPVGAESFSEALRWGAEVYHTLKGVLKERGLSTGLGDEGGFAPNLDSNRDALDLIVEAIKKAGYQPGQDIALALDVAASEFHKDGVYQFEGKARTASEMTAYYAELVEAYPLVSIEDPLNEEDWDGWKTITEQLGDKVQLVGDDLFVTNPERLARGIDNDTANALLVKVNQIGSLTETLDAVELAQRSGFKCMMSHRSGETEDVTIADLAVATNCGQIKTGAPARSERVAKYNQLLRIEEILDDAAVYAGRSAFPRFKG

SEQ ID NO: 43886 - protein, 449 aa, Streptomyces himastatinicus ATCC 53653
MADDRRGRFQAGPAPPVRAVKGRVPFLRRSPAEGRTPLTAGARRVIALNNGFQLLFNLLWWMPVFYAYQRQAGLSDAQIFGIQSLYYIAFCLFEIPTGLVADRIGARNCLRAGAVVMTAANLVPVLSPDYTGFLVHFLAIAAGRSLTSGAASAYLYDALHAEGADDHYLRAEGNARALGLAAKVMCWPLVGPLMALSRPTPYLLSAVSAGASLACAMALPRLAGAESGTRRSGVWREAGRALRGLRGSPWLALVMVQGVAVFTLSRICQVNLFQPILIDQGIPEPSHGSVLAAVTVAEAVGAARPQWLGRKLKPLTLVSVLSLAMAVSLAGITLGGPMAAVALLCLFSAVTGFAYPIQRKLVNDAVPPGAPRATLLSVESIIDRAVCALVAVAAGAYLSAGRMDALLWHSAAVTAAVMLAVHLAVLIGCPRPPRAAREERQEAVGHART

SEQ ID NO: 43887 - protein, 205 aa, Streptomyces himastatinicus ATCC 53653
MSAQLRYWHLDPLIDPAALGVTELLTNVHRHAEPDKQCTVEIALMMDRLTVSVRDQDPRLPRVRECDPVSTHGRGLALVAAVSQTWGMHVRDDGSGKVVWFTLAVPQPTTVNGSPYAAYGAARTAPPPHRATPAARPATAPTPASAPAPVSPVSPVTPVSPASPGSPVTPVSAPAPVAAPAPAPAAASAPPVRERAPAARSAVSH

SEQ ID NO: 43888 - protein, 483 aa, Streptomyces himastatinicus ATCC 53653
MLRGQAAYGGALQRHVLVTIDPQPRSGRDEDVSPSTRTTPRGPRRSVLAALGGALASLLAVMLLGAPTASARTATTEASAATEASAGTKAPTAALTEIKNFGTNPSNLQMYLYVPDNVAPNPAVVVVVHYCTGSGPAMYSGTEFASLADRYGFIAVYPSVTRASKCFDVSSPQALTRGGGSDPVGIKSMVDWTVRTYSADTSRVFATGTSSGAMMTNVLLGDYPDVFAAGSAFAGVPFACFATTNGSEWNSDCANGTITRTPQQWGDLVRGAYPGYSGPRPRMQLWHGTQDDILRYPNFGEETKQWTNVHGVSQTPARTDSPQSGWTRTRYGSTGDRAPVEAISLQGVGHNLVTSGMAARVITFFGLDANGPAPQPQPGACRVSATTSAWSTGLTASVAVTNTGTTTLNGWQLGFTLPSGQTITGGWGATYSPASGAVTATNAAYNSTLAPGASVTIGYQANHTGTTSAPGGFTLNGKTCTAT

SEQ ID NO: 43889 - protein, 284 aa, Streptomyces himastatinicus ATCC 53653
MTAAAVALPAALVFTGVGVGVGVGQAATPAHSSARASAQESAQEAGVAANLDDPAKKEIAMKLVSSAENSSLDWRGQFKYIEDIGDGRGYTAGIIGFCSGTGDMLELVEYYTQQKPGNVLAKYLPALRKVNGSDSHSGLDPNFTKDWKTAAADKAFQDAQEHERDRVYFNPSVKQGKDDGLGTLGQFIYYDAIVMHGPGSSKYSFGGIRKTAMSNAKTPAQGGNQTTYLNAFLDARKKAMQSEEAHSDTSRVDTAQRVFLNAKNFDLNPPLKWKMYGESFEIKS

SEQ ID NO: 43890 - protein, 303 aa, Streptomyces himastatinicus ATCC 53653
MWRRRAMAWFAALAAACALLFGMPMASASADPAGTADTAPRAACSYPDWVAGKWYVTGDIVRYTDGRYYRAEHDNPGYDPVISTWYWEPYDCGGGGNSGFVVSEAQFNQMFPNRNGFYSYQGLTAALGAYPGFANTGSDTVKRQEAAAFLANVSHETGGLVHIVEQNQANYPHYCDWNRPYGCPAGQAAYYGRGPIQLSWNFNYKAAGDALGIDLLNNPWLVQNDSAVSWKTALWYWNTQTGPGTMTPHNAMVNQRGFGETIRSINGSLECNGANPGQVQSRIDAYQRFVQILGTTPGSNLSC

SEQ ID NO: 43891 - protein, 302 aa, Streptomyces himastatinicus ATCC 53653
MRKKTRMTIRAKKIAINPLQFVQTEDGWIDPALAPPLPERLKIISDAGLRAVHADVPADMTAAAYGKLLADHGLAPAPGYISGPLPEDDASLRAHLDKTARISEQQAELGLSTVFVATGMSKEAPRVRRPAVGAESDRGRLERVRDVFAKMGETARANGVAAAFHPHVGTWAETEEETRFILDTVPADTLSFGPDIGHLGWAGADVPGLLRDYGDRVAALHIKDYHADVAARGTAEDLDYRATVLAGLWAEPGHASVDIPGLLAELPADFDGWLIIEVDRGAQDTAEESIRLCGQWAARQTH

SEQ ID NO: 43892 - protein, 230 aa, Streptomyces himastatinicus ATCC 53653
MIDVILPALPERELTLVSEETPQAPALTGHITLGGPVCVPVTPELVDGDPELLAFVDAEAHAAAVYHLLLCAVSCAQDAAEPALHTVNLDLTLSTDTGAAGPAAFGPVAWSMAPHQLTDTADASAPVRLGPRLALRDDSHAPPPGERVCLEARRELRSDPGWEIRRTETVPISGTYRLAMVVRAPRGTVSLAAVAVGATVREGHTPHRFRAEIAQPVRLADRECVAPGDR

SEQ ID NO: 43893 - protein, 391 aa, Streptomyces himastatinicus ATCC 53653
MRRRRRHGLELATGCTVAIAALFLAGAGIPATASPSPPPGSHREVPPEVLAAMQRDLGLTADEARTRISNEYKAGQAEPGWRKNLGSSYAGTWVTGNTAELTVGTTDQAQSGAITASGAKATVVGHSLEKLNAAKDALDRVAEERPPSATTASLWYVDVKSNSVVVQSAQPTAAQRFIDASGVDRAVVRIVESAERPAPLYDLRGGEAYYINATARCSIGFSVTQGTQAGFVTAGHCGDAGDTTTGFNRVAQGTFQGSVFPRSDYAWVATNANWTPTPLVVGPNSTTITVTGSQEAPVGSSVCRSGSTTGWHCGTIQQHNTSVVYPEGTIRGVTRTNVCAEPGDSGGSFVSGTEAQGVLSGGSGNCTVGGTTYYQPVNPILSAYGLTLTTG

SEQ ID NO: 43894 - protein, 587 aa, Streptomyces himastatinicus ATCC 53653
MYALTELFPAAAVEAAEKAAFGGTGDLAGAPLPGVRVRVDGMAPGKGELLLAGPAARHRYLGEDPDPWVRTGDRARWEGGRIVLEGRLKNMVLRRAENIYPGLYEPSLHVTGVELALLVGVPAGDGDERLVALVQPSPGADPRRVRALLAGPLERMGSARPDAVLLTDIPLTGRSRKPDRAEAARRAAARLDGLAVRFSIRRLRPGPPGGRAPGGDRRNGTPRHDAAEPGVPAGPPPGPPRLPGGAPGAPRPARRHPRPPGRAPGLHGPGARRRGLPPGAHPCPAGPYGRGLDRWRGARRAVRSQGSGAAVRPGGRRPPGHPAGTRRRPRRGRGGPAATGVARRSRPAAGPARGARRHGGSGGGGHETAGATVCALLDIDADPRAVAAAASDAAAAAVRDHLPGPRRPGDDATAAARRLQNLLATEGRDDGALRAMLATAAVATTVAALPRAVAWCADAGLWQDAAADALRPALVAELLRVVAPSPVLPRVAAADATLAGVTIRRGDRIVLVARHAVRDHRTGPDARCPVEPGRLPNCSSARARTPARARHWRGPSSRTPWPRWRRTVPPSSAPGRTATRRSPAGGR

SEQ ID NO: 43895 - protein, 425 aa, Streptomyces himastatinicus ATCC 53653
MVCGGLLVAQSSPGGSAHGAESGGSSQVLDGENAEGGPRTDLGSRLVNELGASRTAGNWTAADGKPVVAVTDADAADAVSRAGARAKRVRFSMDQLKSATETLRSAPRVAGTAWMVDPKSNKVMVLGDSSVSTSDWSKMKDMAEPMADEVNMQRTTGTFTTKTNGAAPIFTNGSRCSAGFNVTNGQTGFILTAGHCGPPGTPWFQDTAGKTSIGTTVQTNFPGNDFSLVRYDNTKLSRNSVLDAGNSQQVKITNAADPTVGQEVFRSGATSGLRSGKVTGLNATVNYPEGSVSGLIQTTVCAEPGDSGGPLFVGNTALGVTSGGSGDCTKGGVTFFQPVTKAMTALGVTIPGTRIGDAGGGTADNSAIASGTQAAQDDATSLDGIMERARAFGPGLWIIAGGVVGFAISLRPRRRRYNSYYSPGW

SEQ ID NO: 43896 - protein, 413 aa, Streptomyces himastatinicus ATCC 53653
MNTTGGPCVSTAVANPSPAYDPVRPTGGHKLSRSHKRAPKTKIIIGAAAAAAVVGAAIVLPNANASQDKKSEAIDAKPKAFNSDSASDAIAQLASSLGEAFGGAWYDKDQQQVIVNVIGDNNNVEVAAVKSAGAVPKAAKNSMKSLKAAESTLKKKATMAGTAWAINPKTNKLQVTADSTVKGAKWDTLESTVKSLGADMASVKRSAGTFKTFAEGGDAIFGGGSRCSLGFNVTTESGDPGFLTAGHCGVAAKEWSETQDGAPVATVQDATFPGTGDFALATYDDAATEAPSTVNTGDGNKVNITEAAEASVGQEVQRMGSTTGLNGGSVTGLNATVNYAEGSVSGLIQTDVCAEPGDSGGALFTEGGQAIGLTSGGSGDCTAGGETFFQPVTTALEAVGATIGDAGAGGAAQ

SEQ ID NO: 43897 - protein, 396 aa, Streptomyces himastatinicus ATCC 53653
MAGRQLPAAIEEFASYLRALTRRIDPDKGWYAVFAQRDPDGLRACLDGQEIPPWDVVQALLQDLSAQRGAQTANVAAARAAALYRASITAHDAAPGTREALRARLAAMQRERFAAADRERDLHAAKRAGAGTTPDGDPVDAALAWAQDDHYRATARCEELTARLAALPAAPGEPAPPGAPGAPSPWGGGGGPQVAPGGGPAGRPQPGGARPAPAGAGSAGVPSATAQWSAAGPGGPQGAPGAGPAGRPQPGGARPAPAGAGAPPGAPGAQMPGAPPGPGGGSSAAAGEDEPAGAPPGTERASWVAGGLQDPSIAGLGGRTQPDDGPSAPPRPRGARFAAAYDGAPDPAPVPPAEQTAPPRGARFAGAGQQAPAPRGARFPGVRGGARKREREAEER

SEQ ID NO: 43898 - protein, 225 aa, Streptomyces himastatinicus ATCC 53653
MTGARRKDARPPFKLPRAEWLIAVTLAFVVLLLGWLAVQVVSLTQDLRTSNSARDALARQVQGLGASPVAGPPGSRGTPGGVGPSGPPGSPGPTGRPGEDGKDGRDGPSGKPGGPGPSGSPGRPGANGASGSDGANGADGAEGPAGPPGPEGPQGAQGPQGEKGDKGETGDRGPAGPACPDGYSLQAPSYDPDALVCRRDGAPDPQPSDTSGTGLLGMPIDRRRY

SEQ ID NO: 43899 - protein, 499 aa, Streptomyces himastatinicus ATCC 53653
MTIVKGKLIGPADPSRVEVTAELVDVTGARAVGYVASAEGEIVQPVRITPESDGSWSADLLPNAGIVAAAGDTLWAVMEGRALDGTPVLTHILVPETGGPYWLGDLRADLSGTLSGGGTVVYVPGVPGPAGADGATGPSGPAGADGAPGPQGPTGATGPEGPAGPAGAAGADGAPGATGPKGDQGDPGPQPPLGAAGAGPEVALRSDDPTTTNARTPLSHASTHAAAGSDPVTPEMVGADPAGAASGQVAEHTGATDPHGDRAYSDGVTGPIASRVTAVETGFTNVNAYITDALNRVQALENGALYKAGGTISGSLAVTGHALGQDTPAAHGVAAWCYDPALAVNSTQLANGTLYLVRVNVAANVNVTKIYWWVANVGFSPVSGQNQVGLYDSAGALLAAANVDAAISSATLKATTIAAQALTAGEFYWVGMVFNAAGAPTLTRGSGWTGVDAAANLGLTAATYRFATNGTGRTALPSSITPGSNSGTDFAGPWVAVGA

SEQ ID NO: 43900 - protein, 323 aa, Streptomyces hygroscopicus
MRTARRTRRRGRLTAAVSGLFITAALATVGTSAAASSAMTATSAPSATATPPSVSTPVSGAATPVSGAASSVSGAASAVASLDVPGTAWTVDERTGTLRVLVGSTAREADLARLDRTAERFGGTITVERLDGPLRTLLSGGDGIHSTTGLRCSAGVNVQSGTTYYFVTAGHCTDAAPTWYTGSDATTPVGSTTATSFPGNDYGVVRYTNTAVPHPGTVGTVDITGTATAYVGQQVCRRGATTGVRCGQVIALNATVNYGGGDVVSGLIQTNICAEPGDSGGPLYAGDKIIGILSGGSGDCATGGTTFYQPIQEVLSAYGLTVY

SEQ ID NO: 43901 - protein, 111 aa, Streptomyces hygroscopicus
SLYPASALVLTVGHGADAATAEVQRAVTLSCRPTPTGTHPAPAQACAELHSVGGALGLLRTGAEPGRMCTKEWRPITVTAEGVWDGRRVSYEHTFANNCFKNAAPTTVFEF

SEQ ID NO: 43902 - protein, 519 aa, Streptomyces hygroscopicus
  subsp. ascomyceticus
MQPPPFRGILTPLFPLSSSPPVGSLSRPGRRGVLTRLVAVVALVLGAALLGPAPTAHAAAGLAKPGLTKADLTEVADFGTNPGRLNMYVYRPASLPAEPAVVFALHGCTQDAQGYADNSGLLSFADRYGFLLVFAETTSSNNANRCFNWFQSSDNRRGQGEAASIRQMAAHTVSAYGADPQRTYITGLSAGGAMTSVMLATYPDVFQAGAVVAGLPFGCATDVSSAYLCMNPGTDLTADQWARRVRDGYPSWSGPWPRVAIWHGDKDTTVAPRNADELRDQWTAVHGVSQTPDRTSVIGPNSTRHEEYLAADGSVAVEVNRVPGIGHGTPVDPGTGAQQCGSTGAAYFLDSICSSYWITQFFGLSGSASDPGSLPAPSGLAATGATDTTISLTWKPVDGATDYAVHRDGAQITTSATTSYTDTGLRAGTSHTYAVAARDADGKAGPLSGAVTAQTTGATAVCWTAGNYAHVQAGRATTSAGYTYAKGSGQNMGLYNTFVTTTLKESPTGYFTVANDTCP

SEQ ID NO: 43903 - protein, 162 aa, Streptomyces hygroscopicus
  subsp. jinggangensis
  strain 5008
MTVTKTVSAAPATQDAKTASDGVLKLGAKKDIKDDAKNWHVTVQALDYQQPYKGPQPQKPEDFQGGDVWATVSIKVCNITGTDISVSQFPWSLAYADGTSVEVTGNTGGDMPKPEFPMDKTVKAGRCAAGLIAYPVPSSKRPERIVYAPDGMEPTEWAVLKS

SEQ ID NO: 43904 - protein, 300 aa, Streptomyces hygroscopicus
  subsp. jinggangensis
  strain 5008
MRIKRTTPRGGTARRVQLTAVAAGFLAAAAFAAPTANASDVHTFSATQLTKASDSVRQADVPGTAWAVDSKTGRVVVTVDSTVSQAEIAKIKKQAGANADALVVKHTPGKFNKLISGGDAIYASSWRCSLGFNVQDSSGNYYFLTAGHCTDGAGTWWSNSSHTTTLGTTAGSSFPGNDYGIVRYTNSSVTKSGAVGSQDITSAATPSVGTTVYRRGSTTGTHSGRVTALNATVNYGGGDIVSGLIQTTVCAEPGDSGGPLYGGTTAYGLTSGGSGDCTSGGTTFFQPVTEALSAYGVHVY

SEQ ID NO: 43905 - protein, 226 aa, Streptomyces hygroscopicus
  subsp. jinggangensis
  strain 5008
MSECADTTRNTARPDGARKGRTTAALAGAALLAPLGLLAATGNAAAADNGVWDRIAQCESGGNWHINTGNGYYGGLQFSAGTWRAYGGTAYAPTADQASRSAQIAVATRVQQAQGWGAWPVCSGRAGAFGAAPAAARTGSSGTANRTSGATTKSAPTRSTPAQAPERPAATTHRGAPHGDYTVRQGDTLSTIAARHGTTWQRIYAANKAVIGDDPNLIVPGQRLAL

SEQ ID NO: 43906 - protein, 149 aa, Streptomyces hygroscopicus
  subsp. jinggangensis
  strain 5008
MRTNIFTRTLLATATTVALAAGSLAAAGTAFAAPATAHPAAATEAVTPQAVTNLGLNATEAKKVQRWLKTYWNYRNSIDGKLGTNSWKAFQRCLKKYWGYTGPIDGVVGKGTIKALQRLLKDSYGYRGPIDGIAGSGTKAAFKRFANAH

SEQ ID NO: 43907 - protein, 285 aa, Streptomyces hygroscopicus
  subsp. jinggangensis
  strain 5008
MVYADREAAAAASPAGLSRLSRRTVVAALGAVASGALLGVSRAGTASAAAPGLDDPAKKEIAMKLVSSAENSSLDWKAQYKYIEDIGDGRGYTAGIIGFCSGTGDMLDLVQLYADRKPGNVLAKYLPALRKVNGTDSHQGLDPNYPADWRKAAQDTAFQQAQNDERDRVYFNPAVAQGKTDGLRALGQFVYYDAIVMHGDGDDPTSFRNIRKRALRSAKPPAQGGDETTYLNAFLDARVWAMKQEEAHSDTSRVDTAQRVFLRKGNLDLNTPLDWKVYGDSYHIG

SEQ ID NO: 43908 - protein, 431 aa, Streptomyces hygroscopicus
  subsp. jinggangensis
  strain 5008
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGTEVYHTLKKVLKSKGLSTGLGDEGGFAPNLGSNREALDLILEAIKEAGYIAGQQIALALDVAASEFYKDGKYLFEGKERSAAEMTEYYEELVAAYPLVSIEDPLFEDDWAGWKVITDKLGDKVQLVGDDLFVTNPERLARGIEEGAANALLVKVNQIGSLTETLDAVELAQRNGFKCMMSHRSGETEDVTIADLAVATNCGQIKTGAPARSERVAKYNQLLRIEEILDDAAVYAGRSAFPRFRGGISKG

SEQ ID NO: 43909 - protein, 243 aa, Streptomyces hygroscopicus
  subsp. jinggangensis
  strain 5008
MLFSSKGKHRRPSKAVRAIALAGVTGAAVAAPLMAAGNASAATASQWDAVAQCESGGNWSINTGNGYYGGLQFSASTWAAYGGTQYAGTADKASKAQQIAVAEKVLSAQGKGAWPVCGTGLSGTPYNGSAPSTSTPSTSTNSGGSTNSGGSTATRSTGEQAASRSAERPAASASKSRSKTVTTPTGKKVKKGDGEYKVVTGDTLSSIAEKHHVQGGWQKLFELNKDIVEDANLIYPGQQLHLK

SEQ ID NO: 43910 - protein, 363 aa, Streptomyces hygroscopicus
  subsp. jinggangensis
  strain 5008
MLSGNGRHRRPRQAPALLVAAGVTGSAIAIPLLGAASANAADGTTWDKVAECESGGSWSADTGNGYYGGLQISQEDWNAYGGGQYAASPDQASRNQQIAVAEKILADKGTTPWATCALLSGLTEDSGATHVDTGVGGSGGSGGSGGSGKTSGSAGNSGTSGTSGSSDGSDSSGLPDSSPSADADSDTNSGSGKGSSSDKTTTPSAKPDKDAGAPTGSKGADTPKSDKSTAPDTGSPQGADSSPTAAPDTGIGDTPQQAAGSWSLVDTGSLGGGRHRGASADESGRGESVTNGQSASSSGRHASRETDTYTVRQGDTLASIADSLDVDGGWRALYAGNKKAIGTDPNHISAGQTLDVGGETGGK

SEQ ID NO: 43911 - protein, 430 aa, Streptomyces hygroscopicus
  subsp. jinggangensis
  strain 5008
MTGTDARRDVAGQGVREAAAGAPAVWSRDFALFFVARAVARLGDTMLPVALAAGLLEHGYGAGAVGLAMASTAAAFAGLVVFGGVIADRFSTRRLMIGADLVRLGTQSLAAGLFFTGHVVLWQICAIGVVNGVAGAVFQPGVASTVPRLATDIQGANGAIRIAESAAQLAGPAVAGVLVGLASPGGVFAAHAATYALSALCLLLLRLRPLPVAARAAAGSALRAFRTDLVDGWREFRSRAWLWGVIAVWCLYMIAVWGPTVPLVATEVVRHHGPGAYGLVNSALGAGTVVGGLLALRLRPRRMLRAGALSLFAFFGFPATVGAGLGVPAMAAGAAVAGAGMSFWGVMWATTVQTQVPADVLNRIHAYDVAGSLAMMPVGQALAGPAAESLGAGHVLLTSAAVSLAVAALLLAIPPIRDLTRADARASAAA

SEQ ID NO: 43912 - protein, 457 aa, Streptomyces hygroscopicus
  subsp. jinggangensis
  strain 5008
MSTSPYETYDPYGPDASVPTAETLPYGIPEDTYRPAYEAEAYFVTDPAPPLPRQTPAPEAETSEASEAFEAFEAFEETGGQAPRRRRARYGDRPDSTVRRLLPQALVVAFLAGGTTAFVANDKAVELSVDGRQRSLRTFADDVSELLAEEGVRVGAHDMIAPAPGTALASGDAVAVRYGRPVRLTLDGRRREVWTTARTVEGALDELGVRAEGAYLSTSRSQRIGRAGLALDVRTERAVTVLADGRTRTVRTNAATVREAVEEAGITLRGQDTTSVPPDSFPRDGQTVTVLRVSSTREIHEEQIPFAVERTADPTVFQGTEVVARPGQPGLRRTTYYVRTVNGVRQKPRPERSEVVREPRAQVIKVGTKPRPPSVSDADGLNWRALAVCESGGRPDAVDPSGTYGGLYQFDTRTWQSLGGKGRPQDASAEEQTYRAKKLYIRRGASPWPHCGVRLRG

SEQ ID NO: 43913 - protein, 439 aa, Streptomyces hygroscopicus
  subsp. jinggangensis
  strain 5008
MAAGALLVAGLSGSASARPSSLPAAPTAAETLRTDAAPPALLRALQRDLGLNRQQAERRLGNEAEAGAASGRLRAALGAHYAGAWVRGAESDTLTVATTDPADVPAIRAQGAAARVVDHSLAALDAAKARLDRVAARRATTDTPVWYVDVPTNALVVRAVRTDAARSLLAAAGVDASLVRVVKSAEQPRPLYDLRGGDAYYIDNSSRCSIGFPVTRGTQQGFATAGHCGRAGSATTGSNRVAQGTFQASVFPGNDMAWVAANAGWTATPYVNGSSAQVTGSTQATVGSSVCRSGSTTGWHCGTVQQLNSSVTYQEGTVTGVTRTSVCAEPGDSGGSFVSGSQAQGVTSGGTGNCTSGGTTYFQPVNPILQSYGLTLKTTATGPGDPGDPGDPGGTWSAGTVYQAGATVTYGGAVYRCLQTHQAQQGWEPPNTPALWQRQ

SEQ ID NO: 43914 - protein, 261 aa, Streptomyces hygroscopicus
  subsp. jinggangensis
  strain 5008
MHRKTVLRAALAATAAVPVALIGGPALARTFVAGGTAPGLTPPCDDGDHPTPEQIEGPYFKPDSPERTNLLEPGLPGTRLTVTGYVFGRACLPLSGVLLDFWQADTNGAYDNTGFRLRGHQFTDSRGSFALTTIVPGLYPGRTRHLHVKVQAPHRPVLTTQLYFPNEPRNNTDTIFDPRLLMTVRDGGGGREAAFDFVLDVPQDPGPGPGPSSPENTWTPGTAYRAGDWVTYAARAYVCLQPHTSRPGWEPPAVPALWQAA

SEQ ID NO: 43915 - protein, 384 aa, Streptomyces hygroscopicus
  subsp. jinggangensis
  strain 5008
MAVRGRHRRYQPNRINRASLTVTAGGAGLALPLVAAGTADAADAATWNKVAACESSGNWSVNTGNGYYGGLQFTQSTWEAYGGARFAPRADLATRAEQIAVAEKVLDGQGPGAWPVCSVRAALTRGGPAPDVHTETSSTRPAKTGSAHSGSVRDVQPQTTPQSRAGRAEMYTVVHGDTLSGIAGDHHVTGGWRTLYAGNRATIGTDPDLIIPGQRLSLNGTPTRSAPPKAPKKKAPSEHPTTHRTTPPARHALVAPVTASVGTGYHVAGSHWSKGYHTGIDFLVPTGTSVKAAAAGRVVAAGWGGSYGYQVVIRHADGRYTQYAHLSAIAVRDGQSVTAGQRIGRSGATGNVTGPHLHFEVRTGPGFGSDVDPLAYLRAGGVRI

SEQ ID NO: 43916 - protein, 482 aa, Streptomyces hygroscopicus
  subsp. jinggangensis
  strain 5008
MLPHPTPPLGRARRRTRAARRTALGALSLAAACSLLATPATAAPVGPGPADAHCAAQARLHVPGAAHQQADCLDELTTAGTVATGHTDPADYAGLTPKDLPTPSGVPGIQIDGYFPDTSTTNTNHGWQHDSQFVIRLPDHWNGGLVVAGTPGNREQYANDRAIADWVLARGYAYAATDKGNTGTAFYRDGRRPGDAIAEWNTRLTQLTRAARAVVTQRYHRPPARTLATGMSNGGYLVRWQLENHPELYDGGVDWEGTLWRTDGPNLLTFLPAALRHYPAYAAGGPGAAEAQAALHRAGFPAGSEFLWPYHHQVYWDLTQRIYREELDPGYDGDTEAGTPYCASGTPACDADYAYPDRPADVHRAVGRIALTGRIGKPLITLQGTLDVLLPISQDSDVYARIVHQAGRGSLLRYYRIEDGTHTDSLADVFPDRLRPMVPCHRSAFTALEGWLAGAGRPPADRTVARPADADPAALLTSCPLR

SEQ ID NO: 43917 - protein, 414 aa, Streptomyces hygroscopicus
  subsp. jinggangensis
  strain 5008
MPLSPFSRAPGAPPRARLLPRLLAVLAVVLGTALAGPAPQAHAAVTLTRVSDFGSNPGALTMYVYRPATLPAHPPVVVALHGCTQSAQVYADNSGLPQLADRDGFLLVLAETGTANNASKCFNWFQTGDNRRGQGEALSVRQMVSNAVTAYGADPQRVYVTGLSAGGAMTAVMLAAYPDVFSAGAVVAGLPYDCTKDNSPYTCMNPGVDLSPAAWAQRVRDAYPSYGGPWPRTAIWYGDQDTTVVPRNATELRDQWTALHGLSQTPTRTTTIGPDATRQDQYLAADGTVAVEVDRVPGIGHGTPVAPGTGSEQCGSTAAPYFLDSICSSRWIARFFGLDTSTPGGPDPDPGGGTAACWTASNYAHVQAGRATTSGGYTYAKGSQQNMGLYNTFVTHTLKESPPGYFTVADTGCP

SEQ ID NO: 43918 - protein, 144 aa, Streptomyces hygroscopicus
  subsp. jinggangensis
  strain 5008
MRNTARWAAALGLTAAAVCGPLTGAAVAAPGAAPASLYAPSALVLTTGHGDDAATATPERAVTLTCAPTASGTHPAAVQACAELRGVGGEPDALKPADDVMCAKVYDPVVVTVQGVWQGKRVSYERSFGNACMRDAVGGGLFAF

SEQ ID NO: 43919 - protein, 468 aa, Streptomyces hygroscopicus
  subsp. jinggangensis
  strain 5008
MPKRKAAIAVGGVAALGAAALLLPNANASQDQDHAAAGGTAGARTLKAADASGLAGRLQKILGDAFAGSYYDSGKQQLVVNVVSGDSNVIVQAKKAGAVVRQVDNSMAELKATARTLKTRATIPGTSWAVDPRTDKVLVTADSTVTGANWNRLRSTVRGLGSGMATLKKSSGTFKTFVSGGDAIFSQVQGGSVRCSLGFNVTASDGSPAFLTAGHCGVAAKKWSDSETGQPIATVDQATFPGAGDFSLVKYDDPNTQAPSEVNAGNGQSVQINQAADATVGETVFRMGSTTGLHDGQVTGLDATVNFQSETDPNGVDTVTGLIQTDVCAEPGDSGGSLFTQDGSALGLTSGGSGDCTSGGETFFQPVTTALQATGATLGGGGGGGGDNGAGDQAGAGDQAGAGDEAGAGAGDQAGAGDQSGAGDQAGAGDQAGAGHQAGAGGDRIGGGADPSGTGAADDGSSSLTDSR

SEQ ID NO: 43920 - protein, 458 aa, Streptomyces hygroscopicus
  subsp. jinggangensis
  strain 5008
MRHARRRVVRRVTRLAAVGGLLLGGAMVTQAAMASETPSAPARPLAATGDTGAALVARLGTARTAGDWIGADGRTVVAVTDEAAAREVRRAGAEAKVVPHSMNELKSATATLRSAPRVPGTAWAVDYRTNRVVVRADRTVSAGDWSRLTRVATGIGGFVHMERTKGTFTTRLNGAQPILSTGGRCSAGFNVTDGRSDFILTAGHCGPAGSTWFADNQGGQQLGRTVNSSFPGSDFSLVQYTGGKAGAGADVVAIGGGKGVRITGAADPAVGQRVFRSGSTSGLRDGRVTALNATVNYPEGTVTGLIETTVCAEPGDSGGPLFSEGIALGVTSGGNGDCTAGGTTFFQPVTKALTALGVRLIVSARNAGGAPGGTPSPAPAASAAQGAMAPNAASPGSSAPVTGAPQGSTLLARLTDTRNVGPGLLVIAGSLIALVATRYIRAEQDRKAYRRHYSATWG

SEQ ID NO: 43921 - protein, 438 aa, Streptomyces hygroscopicus
  subsp. jinggangensis
  strain 5008
MLPTPHRSGTGPRKALVALLGALLPLLAALALAASPATARERAVPAATLTEVTGFGANPSNLRMYVYAPGNVTAHPAVVVAVHWCGGSASAMYSGTEWASLADRYGFVVVYPSVTRASKCFDVSSPQALRRGGGSDPVGIRSMVDWATRTYAADTGRVFVTGNSSGAMMTNVLLGDYPDVFAAGAAFSGVPFGCFATTDGSEWNSACAGGTVSHTPQEWGDLVRAAYPGYTGPRPRMQLWHGTADDTLRYPNFGEGIKQWTNVLGVSQTPAATDTPASGWTRTRYGATGDRAPVEAISLQGVGHNLYGPGMASRALTFFGLDGGATTPQPPAGACAVTAGVSAWSTGLTASVTVTNTGTTALNGWKLGFALPAGQTITNGWNATFSPNSGAVTATNAAYNATLAPGASVTIGYQATHTGDSAAPAAYRLNGSACTVGP

SEQ ID NO: 43922 - protein, 402 aa, Streptomyces hygroscopicus
  subsp. jinggangensis
  strain 5008
MRRTRLTHAVLAALLILGGSGAAGAVPAAASGATTPPGAATPLGSAASPGSAAEPASEGVLIAMQRDLGLTRKQAEARLAAERAAAALDPRVRRAAGDAYAGSWFDAAKGRLTVALTPDAPPGTRRAIEAAGAETRTAAHTARELDAVKARLDRLPAPSGVSGWHVDPRAGTVVVDVVRKHRSDNDVRRFVSRARETGPVTVRTVSAAPRTFAAGTVGGDPYYTGNVRCSIGFSVYGGFVTAGHCGSPGAGVSGWDGSYIGTFQGSSFPDNDYAWVSVGSGWWTVPVVLGWGTVPDQLVRGSAVAPVGSSVCRSGSTSHWHCGTVLALNETVNYSQGAVHQLTKTSACAEPGDSGGSFITGDQAQGVTSGGWGDCAGGGETWFQPVNEILSRYGLTLHTYTG

SEQ ID NO: 43923 - protein, 229 aa, Streptomyces hygroscopicus
  subsp. jinggangensis
  strain 5008
MASFRSSTGSKQTRRLLTLALGLGLASAALGTASPASAQNTAEAPARTATAGYVGTADSAGSKAFFDAVLKSVAERQADQPSLKVVTVYYNASQAPSFRSQISSAASIWNSSVSNVKLQATSGAGDFTYYEGNDPRGSYASTNGHGIGYIFLDYAQNQQYDSIRVTAHETGHVLGLPDHYSGPCSELMSGGGPGPSCTNRYPNATERSRVNQLWANGLAKALAKVNRAG

SEQ ID NO: 43924 - protein, 771 aa, Streptomyces hygroscopicus
  subsp. jinggangensis
  strain 5008
MTGPMRMTRRALLLAAALAAVPAPGARAADDPYDVLRRRWLGIALGAGYDPAAEPYASRLARLGQQAREFQAGMVAAPGSLWPGHPFDPPSGITFSYGRLWTMAQAYVQAGTGSTGDPGLLADVLRGLDHLSATVYNPATTRYGNWWEWQIGSPRLLTDITAALYEQAGPARVAAACAAVDHFVPDTMLTDYSGTSTGANRVDLCRSVALRGILGRSPEKISLARDALSPVFPYVTRGDGLYADGSFVQHTWVAYSGTYGQVLLDGLGRLFALLAGSEWEVTDPARRHVLDSVEHAYAPLIHDGLVMDCVNGRAISRGYLRSDDQHVLRGDHYHGQALIAAVALLAGGASPAERERWHGRIKGWIERDTVVPMLTSRQFDVADLARLHAIADSPAPAAPEPLGHRLFPAMDRAVHRTPRFTAALAMASDRIAHYECGNGENPRGWHTGSGMLSWWPRGISDQYTDWYWPTVDWYRLPGTTVSTKRLSDRAGGEWGAPKPDVRWVGGTTDGTYAAVGQHLKGLGSTLQAHKSWFFLDDAVVCLGAGISCADGVPVETVVDSRNLGENGTQSLVRGRNWAHLEEHGGWILPYGGDLRTLREDRTGAWSDINTTSTDERRTRRWQTLWLDHGTDPEAARYAYVLLPGASRAETAARAADRHWLSVLANDAGRQAVAVPRLGLMAWNFWRAGTVGDLTVSAGASVLVVRRGRTATLRVSEPPRTGAPLELVWNRPVRAVTRADDSVEVLSADRRLRLRVTPGMACATHECELTLR

SEQ ID NO: 43925 - protein, 221 aa, Streptomyces ipomoeae 91-03
MARLTAVGGLLCGGLMVTQAAMATEPATSPPETRSSVLAASGTGTGLVTKLGSNRTAGTWIADDGRPVVAVTDEEAAAEVEKAGARPKMVEYSAKELKSATEVLRSAPRVSGTSWAIDPASNEVVVRADSTVSAKDWKKLTGLAEEIGGSVRMERTGGAYTMRLNGAQPIFGTGGRCSIGFNVADGENEFMLTAGHCGPAGSVWFSDNQGRQEIGRTTESN

SEQ ID NO: 43926 - protein, 276 aa, Streptomyces ipomoeae 91-03
MTAPAEQRVRHRRRVTGRRAAIASVAALGLTGAAIATTSLLSTAGAAVTWPTAKGSKAVSSTIKVSGTYDGKLKKFLAKGALGDGSQDEDQDPIFELADGAVLKNVIIGVPGADGVHCKGSCTLKNVWWLDVGEDAASFKGKSSKAVYKVIGGGARKASDKVFQFNGAGKLSITGFKVRNFGKLVRSCGNCSKQYKRTITLSDIDATAPGKSLVGVNQNYGDTATLSRIRIHGDPKKKLKVCTRFQGNSSGKEPRTLGSGPYGTTCKYKSSDITYK

SEQ ID NO: 43927 - protein, 280 aa, Streptomyces ipomoeae 91-03
AWAIDPRTNKIQVTADSTVTGENWDTIESTVKSLGSGMATIKKSAGTFKTFLEGGDAIFGGGARCSAGFNVTNADGTPGFLTAGHCGVAESEWSEEEGGAPIGTVDAATATFPGAGDFALVKYNDPATQAASTVDLGNGQTVNINAAGEATVGLQVFRMGSTTGLADGQVTGLDATVNYPEGTVTGLIQTDVCAEPGDSGGSLFTEDGQAIGLTSGGSGDCTVGGETFFQPVTTALAAVGATIGDGGAGAGEEAAGGAGDAGAAAGAGEEAAGGAAAGAG

SEQ ID NO: 43928 - protein, 300 aa, Streptomyces ipomoeae 91-03
MSHSHTVAAPEQGAPRSRTRRLLPKPFQLVLQFLLVALVVSGALVTNAGSAIAQNETGASLNQGQLPGVVYRGDSRHPNDIFNSGFWSRGTNYDLQAHVHGDRAHNSGYISTSGSQSVAEQFARSQGINNLDAAARQPRCQGAGWTIGQNIPVIGWLVTSHCAHAVVEARTFVYTINPQFANVVLHVPEQLRGSPSMYNTYRSQDEWAFFRRIPPQAITGVHIYHMEARAAGSLLQLQSLTFRHERWVANPNYNRNFHYNPIADPGANLDWDTGLNIPPIQANEYHRGCNAANRCRGGNG

SEQ ID NO: 43929 - protein, 117 aa, Streptomyces ipomoeae 91-03
VYFGPAVKRAKKDGLGTLGQFVYYDAMVMHGPGSDGLSFGGVRERALKNAASPALGGDETEYLHAFLDARVWAMLQEEAHSDVSRVESAQRVFLEAGNLDLDLPLDWEVYGDSYSLG

SEQ ID NO: 43930 - protein, 260 aa, Streptomyces ipomoeae 91-03
MTSATRPRARTRAMTGTVAAFGLSFGMIMTSGATPADAATWPTPSKSQPVSSTIKVSGVRDGGMVRYYGSGDLAGDGQEEGQDPIFELAAGATLKNVIIGAPGADGIHCEGNCTLQNVWWEDVGEDAATFRGGSTYTVTGGGAKKAADKVFQHNGPGTLNISNFAVSEFKTLYRSCGDCSTQYTRKVNLNNIEVTGTGSTARLVGINVNRGDVATLRRITILNDSGRKVVPCQKYNNNTAVGTGPDSTNCLYSSSDITYR

SEQ ID NO: 43931 - protein, 359 aa, Streptomyces ipomoeae 91-03
MKHRRIPGRRAVVTGAGIAALVAAGVTFQTANASEVAPTPEPKALSVAAAGKLALNLDADLGADAAGTYYDAKSKLLVVNVLDEAAAETVEAAGAKARVVENSLAELKSARSTLKEDATIPGTSWVTDPTTNKVVVTADRTVSKAELTRLTKVVDDLGATAELRRTKGEYKPFVAGGDAITGGSGRCSLGFNVVKDGRPYFLTAGHCTESISTWSAGGQVIGQNEDSSFPDNDYGLVKYTANVDHPSEVNLYNGSTQAITGAAEATVGMKVTRSGSTTQVHSGTVTGLDATVNYGNGDIVNGLIQTDVCAEPGDSGGSLFSGDKAIGLTSGGSGDCTSGGETFFQPVTEALSVYGAEIG

SEQ ID NO: 43932 - protein, 414 aa, Streptomyces ipomoeae 91-03
MLVALLGALVPLLAATLLTAPTAHAAPTASAAADTKAEAAPRAALTEITGFGENPSNLQMYLYVPESVTANPAILVAVHYCTGSGPAMYNGTEYAQLADRYGYIVVYPSVTRSSKCFDVSSPQALRRGGGSDPVGIKSMVDWTVRTYDADTDRVFVTGISSGAMMTNVLLGDYPDVFAAGAAFAGVPFACFATTNGSEWNSDCANGTITRTPQAWGDLVRGAYPGYTGPRPRMQLWHGTEDDVLRYPNFGEMIKQWTNVHGLSQTPAATDSPQTNWTRTRYGSTGDRAPVEAISLQGTGHNLYAWGMGERVLTFFGLNSSGPAPQPPAGPCKVTVTTNAWNTGLTASVTITNTGTTTVNGWKLTFTLPSGQTITNGWGATYGPASGAVTATNVTYNGSIAPGASVGIGYQANHS

SEQ ID NO: 43933 - protein, 300 aa, Streptomyces ipomoeae 91-03
MRITRTTPRSGIARRTRLIAVAAGLAAAAAVTVPTANAAGTQTFSAAELKSASSSVLKADVPGTAWAIDPKTDKVLLTIDSTVSDAELAKIKEAAGDNADALTVKRTPGKFNKLIKGGDAIYASSWRCSLGFNVRSGSTYYFLTAGHCTDGAGTWYSNSGRTTVLGPTTGSSFPTNDYGIVRYSNTSIAKDGTAGSVDITSAATPSVGTNVIRTGSTTGTRTGRVTALNATVNYGGGDIVYGMIQTTVCAEPGDSGGPLYGSNGVAYGLTSGGSGNCTSGGTTFFQPVTEALSAYGVSVF

SEQ ID NO: 43934 - protein, 788 aa, Streptomyces ipomoeae 91-03
MTPTRRTFLLAATAAASLPGQRMSAAADAYDTLRHRWLTIALGDAYDPTAEPYATRLRETGERARAFRATMAPTTRSLWPDHPFDPPAGITQSYGRLWTMTEAYTQPGTGSTGDTGLLADVLRGLGHLSATVYNPSTTRYGNWWEWQIGSPRLLMDIVAALYDRLTPAQRDDACAAVDHFIPDALLRDYTGTSTGANRVDLCRSVALRGILGRAPEKIALARDALSPVFPYVTQGDGLYADGSFVQHTWVAYSGTYGQVLLDGLGRLFALLAGSTWEVTDPNRQIVLDSVERAYAPLLYDGLVMDSVNGRAISRGHLKSDDRHVMRSDHFHGQGIIAAIALLALGATAEERRRWYGRVKGWMERDTVTPILTARQFGVADLARLHTVAASPVPAAPEPVGHRLFAAMDRAVHRRPGFAVNIAMASDRIAHYECGNGENPRGWHTGAGLTLWWAEGLGGRADQYTDWFWPTVDWYRLPGTTVSTKRLADREGGEWGAPKPAVRWVGGTTDGEYAAIGQHLKGLGSTLEAHKSWFCVADSVICLGAGISCTDGVPVETVVDNRNLGEPTAPTASSASASSTAASASAFVRGHGWAHLEGHGGWVLPEGGTLRALREDRTGAWSDINTGGTTERRTRRWQTLWLDHGADPTDAAYVYVLMPGASRRAVAARAADRRWLSVLANDRACQAIHVQDLGVTAANFWGAGTAGPLTVSAGASVLLRRGRGTATLCVSEPPRTGGPIEITYAGAVRSVLRADDSVEVLAITGRRLRLRVTPGTACATHTCELTLTE

SEQ ID NO: 43935 - protein, 234 aa, Streptomyces ipomoeae 91-03
MSACADNTREKARKTQSVRSTQDVRRTRTTAVLAGAALLAPLGLLTVTGNAAAADSGVWDRIAKCESGGNWHINTGNGYYGGLQFAASTWRAYGGTAYAATADKASKAQQIAIATKVQRAQGWGAWPTCSARAGAYGSAPGAPSTGSASTKTTKPTKSTKSTKPAKSASSSAPSRTSSHPDRSTSRDDYTVRQGDTLSGIAAEHGTTWRQVYAANRAVIGADPNLIVPGQRLDL

SEQ ID NO: 43936 - protein, 493 aa, Streptomyces ipomoeae 91-03
MSNVQSSSQPPQPSYETYGAYEAHDTPGSGENHEAYETHGAYDEAYAPYGGHGSGSPPWQSSAHDAETLSYGGHPDTYRPAYEVAEGAYGPAHEALQSVEPGLAARPRRTGGGRGGGGSRRAGRSRRRAAGRSTPLRRLVPQALVVAFLAGGTSAFVAKDKAIELTVDGQPRTLHTFADDVTELLADEDVAFGAHDIVAPDPGTALSSGDEVAVRYGRPVSLTLDGHRRRVWTTARTVDGALRQLGVRAEGAYVSTSRSKRIGRDGLELDVRTERTVTIIADGRTRTIRTNAATVREAVAEAGVTLRGQDTTSVPQAGFPRDGQTVTVLRITRSREVREEPIPFRVRRIADPELFKGTEVVEHAGWAGVRRVTYAVRTVNGVKQRPRRVRTEIVRQPQDQVVKVGTMPASVRGAEGLNWAALAACESGGRANAVDPSGTYGGLYQFDTRTWHSLGGRGRPQDASAEEQTLRAKKLYVQRGTSPWPHCGARLRG

SEQ ID NO: 43937 - protein, 386 aa, Streptomyces ipomoeae 91-03
MAARGRHRRYQPNRINRASLTVTAGGAGMALPLIATGTAEAADVETWDKVAACESTNDWNINTGNGHYGGLQFTQSTWEAYGGTAYAPRADLATKDQQIAIAEKVLDGQGPGAWPVCSVRAGLTRGGDTPDIKPGGGGSTRTIEDVKPQTTPQSQAGKVEMYTVVRGDTLSEIADSQEVKGGWRGLYNANRKTIGSDPDLIVPGQRLSLRATVPKGGSDTDKDVSDEKQEQTKQRKEQKERKEQKADKRQSSTSFVAPVSASLGTPYRASGSSWSKGYHTGVDFPVPTGSAVKSVGSGEVVTAGWGGSFGYQVVIRHSDGRYTQYAHLSAISVKDGQHVSAGQRIGRSGNTGNSTGQHLHFEVRTGPGFGSDIDPIAYLRAGGVRI

SEQ ID NO: 43938 - protein, 232 aa, Streptomyces ipomoeae 91-03
MLFSGKGKHRRPSKTARAIAVVGVTGAAAVAAPLIAAGSASAATASEWDAVAQCESGGNWSINTGNGYYGGLQFSASTWAAYGGTQYASTADQATKAQQIEIAEKVLAGQGKGAWPVCGTGLSGAAYDGAAASDSGSSSNSGSYGSSSSSSSQESAQETRASRSSERATVETPTGKKVKKGDGEYKVVKGDTLSGIAEKENVKGGWEKLFELNKDIIDDADFIYPGQQLHLS

SEQ ID NO: 43939 - protein, 377 aa, Streptomyces ipomoeae 91-03
MTTDRLPIRSRISAKAHHTLRSGHRCRVKGNRMLSGNGRHRRPRQAPALLVAAGVTGSAIAIPFLGATGASAASGTTWDQVAECESGGSWSADTGNGRYGGLQMSQENWEKYGGLDYATSADQASRSQQIAVAEKILADQGVGVWSTCGLLHNLDGDSGSADVDTGVADDSSSSDGSSSSGGSSDSPNSTKSSSSSDSSESSRSTESSESSETSESSANVAEGSTRADIGSNDSSGSTGSGDGTSQESDSSSLDDTESRNSGESGQNGDSSSGEDVGAGRHRGASADEDATDNSRTESSSSGRHASRGGDSAREAVEAVHASYTVRVGDNLTSIANSLGVQGGWRELYAENERTVGTDPDLILPGQTLEVGAETGEK

SEQ ID NO: 43940 - protein, 116 aa, Streptomyces lavendulae
APDAAPASLYAPSALVLTIGHGGAAATATPERAVTLTCAPTSSGTHPAASAACAELRGVGGDFAALKARDDVWCNKLYDPVVVTAQGVWQGQRVSYERTFGNSCERDAVGGSLFAF

SEQ ID NO: 43941 - protein, 227 aa, Streptomyces lividans; identical to SEQ ID NO: 43628

SEQ ID NO: 43942 - protein, 240 aa, Streptomyces lividans
MQQDGTQQDRIKQSPAPLNGMSRRGFLGGAGTLALATASGLLLPGTAHAATTITTNQTGTDGMYYSFWTDGGGSVSMTLNGGGSYSTQWTNCGNFVAGKGWSTGDGNVRYNGYFNPVGNGYGCLYGWTSNPLVEYYIVDNWGSYRPTGTYKGTVSSDGGTYDIYQTTRYNAPSVEGTKTFQQYWSVRQSKVTSGSGTITTGNHFDAWARAGMNMGQFRYYMIMATEGYQSSGSSNITVSG

SEQ ID NO: 43943 - protein, 477 aa, Streptomyces lividans
MGSYALPRSGVRRSIRVLLLALVVGVLGTATALIAPPGAHAAESTLGAAAAQSGRYFGTAIASGRLSDSTYTSIAGREFNMVTAENEMKIDATEPQRGQFNFSSADRVYNWAVQNGKQVRGHTLAWHSQQPGWMQSLSGSALRQAMIDHINGVMAHYKGKIVQWDVVNEAFADGSSGARRDSNLQRSGNDWIEVAFRTARAADPSAKLCYNDYNVENWTWAKTQAMYNMVRDFKQRGVPIDCVGFQSHFNSGSPYNSNFRTTLQNFAALGVDVAITELDIQGAPASTYANVTNDCLAVSRCLGITVWGVRDSDSWRSEQTPLLFNNDGSKKAAYTAVLDALNGGDSSEPPADGGQIKGVGSGRCLDVPDASTSDGTQLQLWDCHSGTNQQWAATDAGELRVYGDKCLDAAGTSNGSKVQIYSCWGGDNQKWRLNSDGSVVGVQSGLCLDAVGNGTANGTLIQLYTCSNGSNQRWTRT

SEQ ID NO: 43944 - protein, 335 aa, Streptomyces lividans [sequence omitted]

SEQ ID NO: 43945 - protein, 189 aa, Streptomyces lividans
MTSPSPTARRTRLRRRTALALAAAATAALTLSACGTDTKANTPATRAGSGNAAAAKADTVALLDDTTLAVPGDKPSALFFFSVGCGECAGGAKSLDKAAQAFDKAGKKANFLAVDMDPNESKQTIMQFLDYIKAPALPATIDKGAALSQRYQVAALSTLIVVAPQGKVTYRATDPSADQIQDALKKAGA

SEQ ID NO: 43946 - protein, 144 aa, Streptomyces lividans; identical to SEQ ID NO: 43629

SEQ ID NO: 43947 - protein, 475 aa, Streptomyces lividans
MHRGSLSRGQHVRGTRRRGAALAALAALLVATAPAQAAGSGALRGAGSNRCLDVLGGSQDDGALLQLYDCWGGTNQQWTSTDTGRLTVYGDKCLDVPGHATAPGTRVQIWSCSGGRNQQWRVNSDGTVVGVESGLCLEAAGAGTPNGTAVQLWTCNGGGNQKWTGLTGTPPTDGTCALPSTYRWSSTGVLAQPKSGWVALKDFTTVTHNGRHLVYGSTSSGSSYGSMVFSPFTNWSDMASAGQNAMNQAAVAPTLFYFAPKNIWVLAYQWGSWPFIYRTSSDPTDPNGWSAPQPLFTGSISGSDTGPIDQTLIADGQNMYLFFAGDNGKIYRASMPIGNFPGNFGSSYTTIMSDTKANLFEGVQVYKVQGQNQYLMIVEAMGANGRYFRSFTASSLSGSWTPQAASEGNPFAGKANSGATWTNDISHGDLVRDNPDQTMTVDPCNLQFLYQGKAPNAGGHYNSLPWRPGVLTLRH

SEQ ID NO: 43948 - protein, 919 aa, Streptomyces lividans
MPATRRTARVRRVAAVTVTALAAALLPPLAARADTPPAPPSDAKLAKTAARHDLTREQFYFSCRTLRQRGRRERPRRLTGTRLTTGYDPTDKGFYQGGDLKGLTEKLDYIKGLGTTSIWMAPIFKNQPVQGTGKDASAGYHGYWITDFTQVDPHFGTNKDLKNLISKAHAKGMKVFFDVITNHTADVVDYEEKSYDYLSKGAFPYLTKDGQPFDDADYADGERRFPRVDSGSFPRTPTVPTAKKNLKVPSWLNDPAMYHNRGDSTWAGESATYGDFNGLDDLWTERPEVVGGMEKIYQRWVEDFAIDGFRIDTVKHVDMEFWTQWATALDAYAAKKGRDDFFMFGEVYSADTSVTAPYVTQGRLDSTLDFPFQDAARAYASQGGSARKLAAVFGDDYKYTTDKANAYEQVTFLGNHDMGRIGTFLKQDAPEAGDAELLKKDRLANELMFLSRGNPVIYYGDEQGFTGAGGDKDARQPMFASRTADYLDDDQLGTDRTHAEAAYDTSAPLYRQISALAELRKANPALADGVQTERYAADGAGIYAFSRTDAKTGTEYVVAFNNAGTEPSAAFATGSAGMTFRGLYGTDATVKSGADSKVTVTVPARSAVVLKAAGRLAAPAAEPTISLHAPDPGATGTVELSADVAGGQLNRVVFAAQTGDGKWRTLGTADHAPYKVTHTVDADTPAGTALRYKAVVVDSAGRTASGRLHHRHPARRGGAHRRLPGPRGRPLQARRRELRRLGPVRLGRPRRREAHHLARHPPLHRPGRLRAFAYVKLKPGASTVGFLVIDKDGNKDVAADRTIDVTETGEVWIEQGEEQLVTERPEYPAQDTTKAVLHYKRADGNYDGWGLHVWGDAANPTDWAKPLQPVRTDPYGAVFEVPLTDGASSLSYMVHKGDEKDLPTDQAWTSRPTATRCGC

SEQ ID NO: 43949 - protein, 300 aa, Streptomyces lividans; identical to SEQ ID NO: 43630

SEQ ID NO: 43950 - protein, 354 aa, Streptomyces lividans
MAAGGVVALGAAAILLPNANRSQDGGSSDDAAAAPRTLKAADASDLAARLAGLLGDSFAGSYYDSAPGDNNQVVVQAEKAGAKVRESDNSMGERDQTLKPSRIPGTQWAIDPRTNKILVTADSTVTGDRWDRLESTVDGLGSGMATVRKSAGTFKTFASGGDAIFGGGARCSLGFNVTAGDGSAAFLTRGHCGGGATMWSDAQGGQPIATVDQAVFPPEGDFGLVRYDGPSTEAPSEVDLGDQTLPISGAAEASVGQEVFRMGSTTGLADGQVLGLDVTVNYPEGTVTGLIQTDVCAEPGDSGGSLFTRDGLAIRLTSGGTRDCTSGGETFFQPVTTALAAVGGTLGGEDGGDG

SEQ ID NO: 43951 - protein, 537 aa, Streptomyces lividans
MRKSSIRRRATAFGTAGALVTATLIAGAVSAPAASAAPADGHGHGRSWDREARGAAIAAARAARAGIDWEDCAADWNLPKPIQCGYVTVPMDYAKPYGKQIRLAVDRIGNTGTRSERQGALIYNPGGPGGSGLRFPARVTNKSAVWANTAKAYDFVGFDPRGVGHSAPISCVDPQEFVKAPKADPVPGSEADKRAQRKLAREYAEGCFERSGEMLPHMTTPNTARDLDVIRAALGEKKLNYLGVSYGTYLGAVYGTLFPDHVRRMVVDSVVNPSRDKIWYQANLDQDVAFEGRWKDWQDWVAANDAAYHLGDTRAEVQDQWLKLRAAAAKKPLGGVVGPAELISFFQSAPYYDSAWAPTAEIFSKYVAGDTQALVDAAAPDLSDTAGNASAENGNAVYTAVECTDAKWPANWRTWDRDNTRLHRDHPFMTWANAWMNLPCATWPVKQQTPLNVKTGKGLPPVLIVQSERDAATPYEGAVELHQRFRGSRLITERDAGSHGVTGLVNPCINDRVDTYLLTGRTDARDVTCAPHATPRP

SEQ ID NO: 43952 - protein, 390 aa, Streptomyces lividans
MRRSRLRHLGLAGLLVLGSLTAVGTLPASAADAPAHSPSSSEQPASAGLLDAMQRDFGLTRAEAEDRLAAEREATGIEPAARRAAGKAFGGSWFDADAGRLTVAVTSDATPSALRAVRATGAQARTVEHSAQQLDAAKARVDRLDAPAGVSSWRADRATNKVVVDVVAGERADNDVQSFLKQARATARVTVRTVPSAPQTFAAGTVGGDPYYTGNVRCSIGFSVHGGFVTAGHCGRAGAGVSGWDRSYIGTFQGSSFPDNDYAWVSVGSGWWTVPVVLGWGTVSDQLVRGSNVAPVGASICRSGSTTHWHCGTVLAHNETVNYSDGSVVHQLTKTSVCAEGGDSGGSFISGDQAQGVTSGGWGNCSSGGETWFQPVNEILNRYGLTLHTA

SEQ ID NO: 43953 - protein, 458 aa, Streptomyces lividans
MPHRHRHHRAVGAAVAATAALLVAGLSGSASAGTAPAGSAPTAAETLRTDAAPPALLKAMQRDLGIDRRQAERRLVNEAEAGATAGRLRAALGGDFAGAWVRGAESGTLTVATTDAGDVAAVEARGAEAKVVRHSLADLDAAKARLDTAAAGLNTADAPVWYVDTRTNTVVVEAIRPAAARSLLTAAGVDGSLAHVKNRTERPRTFYDLRGGEAYYINNSSRCSIGFPITKGTQQGFATAGHCDRAGSSTTGANRVAQGTFQGSIFPGRDMAWVATNSSWTATPYVLGAGGQNVQVTGSTASPVGASVCRSGSTTGWHCGTVTQLNTSVTYQEGTISPVTRTTVCAEPGDSGGSFISGSQAQGVTSGGSGDCRTGGGTFFQPINALLQNYGLTLKTTGGDDGGGDDGGEEPGGTWAAGTVYQPGDTVTYGGATFRCLQGHQAYAGWEPPNVPALWQRV

SEQ ID NO: 43954 - protein, 458 aa, Streptomyces lividans
MVGRHAARSRRAALTALGALVLTALPSAASAAPPPVPGPRPAVARTPDAATAPARMLSAMERDLRLAPGQAAARPVNEAEAGTRAGMLRNTLGDRFAGAWVSGATSAELTVATTDAADTAAIEAQGAKAAVVGRNLAELRAVKEKLDAAAVRTRTRQTPVWYVDVKTNRVTVQATGASAAAAFVEAAGVPAADVGVRVSPDQPRVLEDLVGGDAYYIDDQARCSIGFSVTKDDQEGFATAGHCGDPGATTTGYNEADQGTFQASTFPGKDMAWVGVNSDWTATPDVKAEGGEKIQLAGSVEALVGASVCRSGSTTGWHCGTIQQHDTSVTYPEGTVDGLTGTTVCAEPGDSGGPFVSGVQAQGTTSGGSGDCTNGGTTFYQPVNPLLSDFGLTLKTTSAATQTPAPQDNAAADAWTAGRVYEVGTTVSYDGVRYRCLQSHQAQGVGSPASVPALWQRV

SEQ ID NO: 43955 - protein, 280 aa, Streptomyces lividans TK24
MRHPFRDPARPAGPSRRTVLAMACASLATVPLFTPSRAAAASARATGLDDPAKKEIAMQLVSSAENSSLDWKAQYRYIEDIGDGRGYTAGIIGFCSGTGDMLDLVELYGQRSPGNVLAPYLPALRRVDGSDSHEGLDPGFPDDWRRAADQDPQFRRAQDDERDRVYFDPAVRRGKEDGLRTLGQFAYYDAMVMHGDGGGLGFGSIRERALGRARPPAQGGDEVAYLHAFLDERVWAMKQEEAHSDTSRVDTAQRVFLNEGNLDLEPPLDWHVYGDAYHIG

SEQ ID NO: 43956 - protein, 358 aa, Streptomyces lividans TK24
MRGAESGTLTVATTDAGDVAAIEARGAEAKVVRHSLADLDAAKARLDTAAAGLNTADAPVWYVDTRTNTVVVEAIRPAAARSLLTAAGVDGSLAHVKNRTERPRTFYDLRGGEAYYINNSSRCSIGFPITKGTQQGFATAGHCGRAGSSTTGANRVAQGTFQGSIFPGRDMAWVATNSSWTATPYVLGAGGQNVQVTGSTASPVGASVCRSGSTTGWHCGTVTQLNTSVTYQEGTISPVTRTTVCAEPGDSGGSFISGSQAQGVTSGGSGDCRTGGETFFQPINALLQNYGLTLKTTGGDDGGGDDGGEEPGGTWAAGTVYQPGDTVTYGGATFRCLQGHQAYAGWEPPNVPALWQRV

SEQ ID NO: 43957 - protein, 238 aa, Streptomyces lividans TK24
MAAAVGALVAPVVALSLPAPTASAHGWVVSPGSRQDQCANRVVQCGQIKWEPASVEGPKGLRNCSGGDARWADLDDDGKGWRVTPIGTTHTFTWTIEARHATSNWQYFIGDQKIAQFDGHGALPPASVSHQLDFGGFSGRQKVLAVWNIADTANAFYACIDVNIGGGNDGGGGGDGGGDGGGDQPGDCVAGAWSAGSVYNGGETVSHDGHTWRAKWWVTGEEPGTTGEWGVWEDLGAC

SEQ ID NO: 43958 - protein, 297 aa, Streptomyces lividans TK24
MLLLGALPVIAAGVYFAVPDDSADTAAASSSSSATARSDRDDAKDRAEREREADDALIADLPPGLAAPAKKELAQQLVSSAENSTTKWRTAYGSIEDVGDGDGYTAGIIGFCTGTHDLLMLVERYTEDHPDNGLAEYLPALREVDGSDSHEGLDPGFTAAWKAEAEVPAFRAAQEAERDRVYFEPAVRLAKLDGLGTLGQFVYYDAMVFHGPDTDAEGFYGLRERAMAEARTPGQGGSEKAYLETFLDVRKQAMEAKRPGIDTSRVDTAQRRFLTAGNLKLATPLVWEMYGDTYRVP

SEQ ID NO: 43959 - protein, 504 aa, Streptomyces lividans TK24
MRSIRAALTAAATTVAAVGLALSGTVPAQAATPLPDRVFAPYFEAWTGESPAALAAQSGAKHLTMAFLQTATPGSCTPYWNGDTSMPIAQSTFGADFDTIQANGGDVIPSFGGYTADTTGTEIADSCTDVQQIAAAYEKVITTYDVSRLDMDIEIDALDNTAGIDRRNKAIKLVQDWAAANGRDLEISYTLPTTTRGLASNGVALLENAVKNGTKVDVVNLMTFDYYDNQQHDMARDTQTATQGLHDVLARLHPGKSSADLWHMIGVIEMIGVDDFGPAETFTLDNARTVYDWALDQGINTLSFWALQRDNGSCAGGGAADNCSGIQQNTWDFSHVFAPFTSGSTAPENDFSLSATPASGTVTAGASATTTVKTAVKSGTAQTVQLGASGVPAGVTASFSPASVTAGGQSTLTLATTGQAVSGTYSITVTGTGPSGSHSTSYALTVTGGNGNQCTAAPWNSGAIYTGGQQVSHEGHTWKAKWWTTGEEPGTTGQWGVWQDLGAC

SEQ ID NO: 43960 - protein, 300 aa, Streptomyces lividans TK24; identical to SEQ ID NO: 43630

SEQ ID NO: 43961 - protein, 395 aa, Streptomyces lividans TK24
MCAACGIGRVNARQPAFRPARSPQPPGRPPTGGRELKHRRIPRRRVAVVGAGITALVAAGVTFQTANASEAPKTAAPETLSVTAAGELASTLLGDLGADAAGTYYDAQAKSLVVNVLDQSAAQTVEEAGAKARVVENSLADLKSARTALTKDATIPGTSWATDPTTNKVVVTADRTVSEAELAKLTKVVDGLGAKAELKRTKGEYKPFVAGGDAITGGGGRCSLGFNVTKGGEPYFITAGHCTESISTWSDSSGNVIGENAASSFPDNDYGLVKYTADVDHPSEVNLYNGSSQAISGAAEATVGMQVTRSGSTTQVHDGTVTGLDATVNYGNGDIVNGLIQTDVCAEPGDSGGSLFSGDQAIGLTSGGSGDCTSGGETFFQPVTEALSATGTQIG

SEQ ID NO: 43962 - protein, 844 aa, Streptomyces lividans TK24
MSVGLLSQPAGAAGNTGSVVHVAADDPEHAGPPPVAQSPTAETEHVAQGRTKASELPPVAASKDALKEVYGKTAKAPVRPSKSTDKAVAGKTGNSRARAAACNVSDFTSRSGGALVQQIKASTTDCVNTLFNLTGNDAYYAFRESQMTSVAYALRDGSTSYPGNASTGMPQLVLYLRAGYYVHYYNAGTVGTYGSSLQTAIRAGLDAFFASPHSRDVNDANGETLAEAVTLIDSAEENARYIHVVKRLLADYDSTWNSSWWMLNAVNNVYTVTFRGHQVPAFVSAVQSDPGLIDALYNFASGHLALLGTDQSYLTSNAGRELGRFLQHSALRSKVSPLAGGLLNSSSIKGRTAPLWVGVAEMTDYYDKANCSYYGTCDLQAQLARSVLTVTYPCSSSITIKAQQMTSGELSSSCSSLRNQDAYFHNVVRDNGPVANDNNSTIEVVVFDSSTDYQTYAGAMYGIDTNNGGMYLEGNPSAAGNQPRFIAYEAEWLRPDFQIWNLNHEYTHYLDGRFDMYGDFNANITTPTIWWVEGFAEYVSYSYRGVPYTEATTEAGRRTYALSTLFDTTYSHDTTRIYRWGYLAVRYMLENHRADMDTVLSYYRAGNWNAARSYLTGTIGTRYDNDWYTWLAACAAGNCGGGGTNPPGNQAPTAAFTTAVQGLNVTFTDQSTDADGTIASRSWSFGDGSTSTATNPVKTYGSAGSYTVKLTVTDDKGATATATRTVTVGSGGGGGTECTGTDTRELGQNCQRGNQSATTGNYAYLYLYVPAGTTQLKITTSGGTGDADLYYSTSGWPGTTSYTQRATGAGNNHTLTITNPPAGANYISLHAVSSFSGVTVSSAY

SEQ ID NO: 43963 - protein, 294 aa, Streptomyces lividans TK24
MTSDTPTTPDEPGPRPGPGSGADRGISRKTLLRAAVAAGAAVPLLATGGVALARDDARSGDGQRLTPTPYCDDGDDLTPDQMEGPYFKPNSPLRTNLVTPGTPGTPLTVSGYVFGRNCVPLSGVLLDFWQADDNGDYDMAGYTFRGHQFTGATGAFALKTIVPGLYPGRTRHIHVKVQAPGEPVLTTQLYFPGEPRNSTDMIFDPALLMNVRGAGGGKEGTFDFVLNVDGDTGPTDPPTDPPTDPPGGTWASGHAYTSGDRVTYGGRSYRCLQAHTAMTGWEPPNVPALWQSES

SEQ ID NO: 43964 - protein, 793 aa, Streptomyces lividans TK24
MPSPSRSRSRHRAGPALFAAVAAVAGLLLAGLPATASQAADQESCRPDGLYQTPGVDVPYCSVYDADGREKMGADHPRRVIGYFTSWRTGKDGKPAYLASDIPWDKITHINYAFAHVDGGNRLSVGSDGEKNAATGMTWPGVEGAEMDPGLPYKGHFNLLNKFKKQHPDVKTMISVGGWAETGGYFADDGSRVDSGGFYSMATKADGSVNQAGIDTFADSAVDFVRKYGFNGVDIDYEYPTTMKDAGNPLDWSFANGRRAGLVKGYAALMKTLREKLDRAGAADGRHYLLSVAAPSSGYLLRGMETFQVQKYLDYVNIMSYDLHGAWNEYVGPNASLFDDGRDAELAAANVYGSAQYGGIGYLNTDWAYHYFRGSMPAGRINIGLPYYTRGHKNVQGGTDGLWGRASASTCPAGSGLTKCGDGAVGIDNLWHDLDTNGKESPAGSNPMWHAKNLEKGIVGDYVTDYGFPADTKLTGTYARKYDSTLVAPWLWNAEKKVFLSTEDEQSVGAKADYVADRGIGGAMIWELAGDYGWNAATGQYEMGDTLTSLMYDTFRSAAPYGAKKSDADLPVRAVDVDVEFTDFKLGDSNYPITPKLRITNNTRTALPGGTEFQFDYGTSAPGNASDQSGFGTKVIHSDHTGGNAGGLKGDFHRVSLKLPAWQSLAPGATVDLAFNYYLPVSTPSNWTVTIGGTAYALAGDLARGTTVVDPGTQTPTPTPTPTPTGTESPGPSPSPTDGTGQCTAPAWDTASSYGGGTSVSHQGHTWKSKWWTKGEEPGTTGEWGVWQDLGAC

SEQ ID NO: 43965 - protein, 776 aa, Streptomyces lividans TK24
MTPQRPTAPSRRAVLLAAAAAAALTTVPRAAAATADPYDALRRRWLGITLGTGYDPAAEPYASRLAETGERAREHRATMAPTPTSLWPGHPFDPPAGITFAYGRLWTMTEAYVQEGTGATGDPALLADILRGLDHLSATVYHPATTRYGNWWEWQIGSPRLLMDITAALYDHLGADRVAAACAAVDHFVPDAMLGAYTGTSTGANRVDLCRSVALRGVLGRAPAKIALARDALSPVFPYVTKGDGLYADGSFVQHTWVAYSGTYGQVMLDGLGRLFTLLAGSEWEVTDPGRQLVLDSVEHAYAPLIHDGLVMDTVNGRAISRGYLKSDDLHVMRSDHFHGQQLIAAMAVLAGGASNAERERWHARIKGWIERDTVTPVLTAPQFPVADLTRLHAIADAPGEAAPEPVGHHLFAAMDRAVHRRPAFTAGLAMASDRIAHYECGNGENPRGWHTGAGMLTWWANGTRADQYTDWFWPTVDWYRLPGTTVSTKRLADRAGGEWGAPKPDVRWVGGATDGEYAAVGQHLKGLGSTLEARKSWFFLDDAVVCLGAGITCADGVPVETVVDNRNLGEGGTQALVRGRHWAHLEGHGGWIVPGGALRTLREDRTGAWSDINTTSTTERRTRRWQTLWLDHGTDPAGADYVYTVMPGASRAALARRAADRHWLTVLANDDRRQAVSVPSLGLTAANFWQAGTAGPLTTTAGASVLVRRRGRTATLRVSEPPRTGEALEIVWDHPVGAVLRADETVEVLATGRRLHLRVTPGVVCTTHECEVTLS

SEQ ID NO: 43966 - protein, 1102 aa, Streptomyces lividans TK24
MQMTPDGRVPAPQGARSACHGPGRPARSPPLSQGATMLRQTAVAGTVLAMTLAGVVVPASLASASERSAPSAAEPSPVERAVAAADQAVRSGLDALVAGGPDEQYDRHQVTPWDKDLFSVAYERTYHGLPVVGGDAVVLADGKGRVRAVRSATEAAIAVPTEARIKSGQAVRTSRERLANVDEVDSGRLVVRVKDDVQTLAWETVLVGATKDHVPSKLHVFVDARTGKVVDSYDDVKAGTGHSEWNGPNPLTIDTSRSGSQYALRDTTRPGLQCSDYNGGLFTGPDDDWGTGNASSKETGCVDVMYAAQKESDMLRDWLGRNGHNGNGGSWPALVGLNQLNAYWDGSRVTIGHNSANKWIAGMDVVGHEYGHGLDSFTPGGANHESGLGEATGDIMGALTEAYANQPAGYDTPDYTVGEEIDLQGRGPIRNMYNPQLVNNDPNCYSSAIPRTEEHAAAGPMNHWFYLLAEGSSPGGGKPSSPTCDGSRVTGIGIQNAGKIFYGGMLLKTSGMTYKRYRSATLTAAKNLDASCDLFDATRAAWNAIDIPAQSGDPACTRQETDFSLALSPASGNVEAGSAVNATVNTTTVTGSAQQVSLTATGTPPGVSVSFSPSTVTSGSSSTMRVSTTSGTAAGTYSLTVKGTAGSKSHTAQYTLTVGGGNNPGTPPDVDVAQVQAHLAQFGSIAAQNGGNRRSTGSGYDASLAYVKGKLQAAGYTVTEQTCTSGCSAGAGNNLIAEWPKGDANSVYMFGAHLDGVSAGPGINDNGSGSAALLETALTLAEQNPTMDNRVRFAWWTDEEQGLNGSDFYARNLSTTDRSRIKAYYNFDMVASVNGGYFINNLSSSASAPMREYWTSLGLAPQENVEGQGRSDDYSFQQVGIPTSGYATGASAIKSSTEAAKWGGTAGRSYDPCYHSACDTTANISATALNRSADGIAYTIWKTAVGDAPNPQDDFSISANPSSGTVDPGSSASVTVNTATTSGDAQSVRLSASGAPTGVSVGFSPDSVTSGQSSTATVQVAAGTAGGTYTLTLTGAGTVTHTTTYTLTVSGDDGGETTWQLGATYAAGDVVSYNGVSYRCIQGHTAYPGWEPPNVPALWQRL

SEQ ID NO: 43967 - protein, 434 aa, Streptomyces lividans TK24
MSATAVEPAAAIDTVTARRIIDSRGNPTVEVDVVLEDGSLGRAAVPSGASTGAREAVELRDEDPTRWHGKGVDRAVAHVNGEIAASVRGRDAADQAGLDAALIALDGTAAKSRLGANALLGVSLAAAKAAATARRQPLYRYLGGADAHLLPLPMMNIVNGGAHADNPLDFQEFMIVPVGADTFAEAVRMGSEVFHTLRRDLLAAGHSTGVGDEGGFAPALRTAEEALDFVVAAIERTGYRAGPDIGLVMDPASSEFFRDGGYDYAGEGVRRSPAEHADHLAGLIDAYPVVSIEDPMAEDDLDGWRELTDRVGDRCQLTGDDVFCTNEALVREGIRTGVGNSVLVKVNQIGTLTEALATVATAHEAGWTVVMSHRSGETEDTTIADLAVATGCGQIKTGSLSRSDRTAKYNRLIRIEEELGASARFAGRSALRRV

SEQ ID NO: 43968 - protein, 182 aa, Streptomyces lividans TK24; identical to SEQ ID NO: 43641

SEQ ID NO: 43969 - protein, 300 aa, Streptomyces lividans TK24
MRRAALALSAVAALAVGTTATAATTGAAAAPAPRKQGPTSVAYIEVNNNSMLNAGRYTLADGGGNVFDVAVIFAANINYDTGTKSAYLHFNENVQRVLDNAATQIRPLQQKGIKVVLSVLGNHQGAGFANFPSQQAASAFARQLSDAVAEYGLDGIDFDDEYAEYGNNGTAQPNDSSFVHLVTALRANMPDKIISLYNIGPAASRLSYGGVDVSTDFDYAWNPYYGTWQVPGIALPKSKLSPAAVEIGRTSQSTSAELARRTVDGGYGVYLTYNLDGSDRSADVSAFTRELYGSEAVRTP

SEQ ID NO: 43970 - protein, 468 aa, Streptomyces lividans TK24
MGARSGPLERVGVSRTQFEPAEAYTAYTAYDEAYTAYDEAHETYEAHETYESPAPYDLHSAPTLPYGGTYPSAPPPVHEPTVPALPRQSDGRAERRRRARGAGRADASLRRLVPRALVVAFLAGGTTAFVAKDKAVELTVDGSPRTLHTFADDVSELLAEEGVQVGAHDVIAPAPGTPLTSGEDVTVHHGRPVLLTLDGHRRQVWTTAGTVAGALRQLGVRTQGAYLSTGPSRRIGREGLALVVRTERVVTVMADGRTRTVRTNAATVGEVVEEAGITLRGEDTTSVPATGFPRDGQTVTVLRITGSQEVREDPIPFDERRAEDASLFRGTEVVQEAGRPGLRRTTYALRTVNGVRQKPRRLRTEVVREPSPRIVRVGTRPRPASVHGADHLNWQGLAACESGGRADAVDPSGTYGGLYQFDSATWHGLGGEGRPEDASAAEQTYRAQKLYVRSGADAWPHCGARLRE

SEQ ID NO: 43971 - protein, 343 aa, Streptomyces lividans TK24
MLSGNGRHRRPRQAPALVVAAGVTGSAIAIPLLGATGAHAADSANWDQVAECETGGAWSQNSGNGYYGGLQLSQEAWEQYGGLDYAPSADQASRSQQIRIAEKIHASQGIAAWPTCGLLAGLGNGSGGTGDGSGAAGDGASEGSDASGEQDTTKSSESPATTETPESSQSSESSGSSETPESTSGASSSSPSPSSSPSSSSSDAPSDGSSGVSGDSSDGAGQSAKPDTSTESDPSGSAEPQGTEGSSGSGKHRGGSADEGATGEGRTDPASGRHASRDGGEREAGDGRYVVRTGDSLWAIADSLDVDGGWHALYADNETVVGADPDHILPGQTLTVTGESGEK

SEQ ID NO: 43972 - protein, 244 aa, Streptomyces lividans TK24
MLFSGKGKHRRPSKATRVIAVAGVTGAAVAAPLMAAGNASAATASEWDAVAQCESGGNWSINTGNGYYGGLQFSASTWAAYGGTQYASTADQASKSQQIQIAEKVLAGQGKGAWPVCGTGLSGAAYTGGGSEGSGSGSSEGSQSQSSGSTAERSTEQKASRSAERPAAEPKAEKPAAKKKTVTAPTGKKVEKGDGEYKVVKGDTLSSIADEHDVKGGWAKLFKLNDDIVDDADLIYPGQQLHLK

SEQ ID NO: 43973 - protein, 426 aa, Streptomyces lividans TK24 [sequence omitted]

SEQ ID NO: 43974 - protein, 266 aa, Streptomyces lividans TK24
MTAATRPRARRAVTGALGALGLSVGMLMTSGASSAQAATWPTPNGSEGVSSTLSVSGTKDYGMKRLYGTGDLGSGGQDEDQGPILELAPGAVLKNVIIGAPAADGVHCKGSCTLQNVWWEDVGEDAATFRGSSSSNVYTVSGGGAKEADDKVFQFNGAGTLNISGFAVKNFGTFVRSCGNCSTQYRRTINLNGIEVNWKGGRIAGINTNYGDSATLRNITIVGDSSKKIVPCQKYIGNDDGDEPDSNGSGADGTYCKYSSSDITYK

SEQ ID NO: 43975 - protein, 389 aa, Streptomyces lividans TK24
MSRGTSMAVRGRHRRYQPNRINRASLTVTAGGAGLALPLVGTGTAHAADAATWDKVAACESTDDWDINTGNGYYGGLQFTQSTWEAFGGTRYAPRADLATREQQIAVAEKVLDTQGPGAWPVCSERAGLTRGGDPPDIRPAGSAAPAQKTSDSVKDVQPQTTPQSRAGKARMYTVVTGDTLSGIADTHEVRGGWQRLYEANRSAIGSDPDLILPGQRLSLRGQGTTRAPGAEAGRRQDERQPQRDKQRQKQQDKQQKQHRKEQKQEQKQEPKQEPKEQKRQEQKQQEQRKAPKESSSGSKPALFWTTETGPEWPPSTPPPVRPTTRRAPPGPRATTPASTSPSPPAPPSSRSRTAGWSARGGAVRTATRWWSGTGTAATPSTRTSRRSP

SEQ ID NO: 43976 - protein, 121 aa, Streptomyces lividans TK24; identical to SEQ ID NO: 43647

SEQ ID NO: 43977 - protein, 227 aa, Streptomyces lividans TK24; identical to SEQ ID NO: 43628

SEQ ID NO: 43978 - protein, 390 aa, Streptomyces lividans TK24
MRRSRLRHLGLAGLLVLGSLTAVGTLPASAADAPAHSPSSSEQPASAGLLDAMQRDFGLTRAEAEDRLAAEREATGIEPAARRAAGKAFGGSWFDADAGRLTVAVTSDATPSALRAVRATGAQARTVEHSAQQLDAAKARVDRLDAPAGVSSWRADRATNKVVVDVVAGERADNDVQSFLKQARATAPVTVRTVPSAPQTFAAGTVGGDPYYTGNVRCSIGFSVHGGFVTAGHCGRAGAGVSGWDRSYIGTFQGSSFPDNDYAWVSVGSGWWTVPVVLGWGTVSDQLVRGSNVAPVGASICRSGSTTHWHCGTVLAHNETVNYSDGSVVHQLTKTSVCAEGGDSGGSFISGDQAQGVTSGGWGNCSSGGETWFQPVNEILNRYGLTLHTA

SEQ ID NO: 43979 - protein, 460 aa, Streptomyces lividans TK24
MAWSADISARSRRAALTALGALVLTALPSAASAAPPPVPGPRPAVARTPDAATAPARMLSSMERDLRLAPGQAAARLVNEAEAGTRAGMLRNTLGDRFAGAWVSGATSAELTVATTDAADTAAIEAQGAKAAVVGRNLAELRAVKEKLDAAAVRTRTRQTPVWYVDVKTNRVTVQATGASAAAAFVEAAGVPAADVGVRVSPDQPRVLEDLVGGDAYYIDDQARCSIGFSVTKDDQEGFATAGHCGDPGATTTGYNEADQGTFQASTFPGKDMAWVGVNSDWTATPDVKAEGGEKIQLAGSVEALVGASVCRSGSTTGWHCGTIQQHDTSVTYPEGTVDGLTETTVCAEPGDSGGPFVSGVQAQGTTSGGSGDCTNGGTTFYQPVNPLLSDFGLTLKTTSAATQTPAPQDNAAADAWTAGRVYEVGTTVSYDGVRYRCLQSHQAQGVGSPASVPALWQRV

SEQ ID NO: 43980 - protein, 296 aa, Streptomyces lividans TK24
MSRRRISAVVTALALAGAVPLLMPANEASAASCSSYPAWSADANYNTGDIVRYTDGKAYIAEHANPGYDPLISTWYWDPYACDGGSQTPVGNFVVSEAQFNQMFPGRNSFYTYSGLTAALSAYPGFANTGSDTTKKQEAAAFLANVSHETGGLVHIVEQNTANYPHYCDWNQPYGCPAGQAAYYGRGPIQLSWNFNYKAAGDALGIDLLGNPWLVQNDAAVAWKTGLWYWNTQSGPGTMTPHNAMVNGAGFGQTIRSINGSLECDGKNPAQVQSRVTKYQQFAQILGVSPGGNLYC

SEQ ID NO: 43981 - protein, 238 aa, Streptomyces lividans TK24
MAFAVGALVAPLLAVSLPASTASAHGWVTSPGSRQDQCAAGIVDCGQIKYEPQSVEGPKGLSSCSGGNSQFAELDDDGKGWRVTPVGTTHTFTWHHTARHATANWQYFIGSQKIAEFDGHRAQPAPDVSHQVNFGGFTGRQKVLAVWNVADTGNAFYSCIDVNIGGSGGGDGGGDGGGDGDPGACDAPGWSAGSVYSGGDTVSFGGHTWRAKWWVTGEEPGTTGEWGVWEDLGACAAA

SEQ ID NO: 43982 - protein, 144 aa, Streptomyces lividans TK24; identical to SEQ ID NO: 43629

SEQ ID NO: 43983 - protein, 440 aa, Streptomyces lividans TK24
MSHKRIPKRRAAMAAGGVVALGAAAILLPNANASQDGGSSDDAAAAPRTLKAADASDLAARLAGLLGDSFAGSYYDSGARQLVVNVVPGDNNQVVVQAEKAGAKVREVDNSMGELRGGAQTLKAEAGIPGTAWAIDPRTNKILVTADSTVTGDRWDRLESTVDGLGSGMATVRKSAGTFKTFASGGDAIFGGGARCSLGFNVTAGDGSPAFLTAGHCGVAADQWSDAQGGQPIATVDQAVFPGEGDFALVRYDDPATEAPSEVDLGDQTLPISGAAEAAVGQEVFRMGSTTGLADGQVLGLDATVNYPEGTVTGLIQTDVCAEPGDSGGSLFTRDGLAIGLTSGGSGDCTVGGETFFQPVTTALAAVGATLGGEDGGAGAGDAGGAGAGAGEEGDAGGAGDAGDGGAGAGDKGDKGDTGDAGDAGDGAPVGGGDGSGLTG

SEQ ID NO: 43984 - protein, 443 aa, Streptomyces lividans TK24
MARLAAVGGLLLGGTMVTRAVASEPPDASAAPRTFAQTPSGAGGDLVSRLGTGRTAGHWVDSEGRPVVAVTDERAAEAVRRAGATAKRVRHSMSELRSAASTLRSAPRVAGTAWALDYRSNEVVVRGDRTVSGSDWSRLTAVAEGIGGFVRMERTEGAFTTRLNGAEPILSTAGRCSAGFNVTDGTSDFILTAGHCGPTGSVWFGDRPGDGQVGRTVAGSFPGDDFSLVEYANGKAGDGADVVAVGDGKGVRITGAGEPAVGQRVFRSGSTSGLRDGRVTALDATVNYPEGTVTGLIETDVCAEPGDSGGPMFSEGVALGVTSGGSGDCAKGGTTFFQPLPEAMASLGVRLIVPGREGAAAGTSAPAGQAPGTRAPGASGAGAPAPVAGVDGSTLLARLTDRRNIGPGLLVVAGSLVALVATRWIREEQDRKAYRRRYSATWG

SEQ ID NO: 43985 - protein, 144 aa, Streptomyces longisporus
MRNTARWAATLALTATAVCGPLTGAALATPAAAPASLYAPSALVLTVGHGTSAAAASPLRAVTLNCAPTASGTHPAPALACADLRGVGGDIDALKARDGVICNKLYDPVVVTVDGVWQGKRVSYERTFGNECVKNSYGTSLFAF

SEQ ID NO: 43986 - protein, 18 aa, Streptomyces mobaraensis
  Streptoverticillium mobaraense
GTGNSQHSGQVQIGTTKS

SEQ ID NO: 43987 - protein, 16 aa, Streptomyces mobaraensis
  Streptoverticillium mobaraense
QLYAPSALVLTVGQQD

SEQ ID NO: 43988 - protein, 477 aa, Streptomyces mobaraensis
  Streptoverticillium mobaraense
MRKALRSLLAASMLIGAIGAGSATAEAASITAPQADIKDRILKIPGMKFVEEKPYQGYRYLVMTYRQPVDHRNPGKGTFEQRFTLLHKDTDRPTVFFTSGYNVSTNPSRSEPTRIVDGNQVSMEYRFFTPSRPQPADWSKLDIWQAASDQHRLYQALKPVYGKNWLATGGSKGGMTATYFRRFYPNDMNGTVAYVAPNDVNDKEDSAYDKFFQNVGDKACRTQLNSVQREALVRRDEIVARYEKWAKENGKTFKVVGSADKAYENVVLDLVWSFWQYHLQSDCASVPATKASTDELYKFIDDISGFDGYTDQGLERFTPYYYQAGTQLGAPTVKNPHLKGVLRYPGINQPRSYVPRDIPMTFRPGAMADVDRWVREDSRNMLFVYGQNDPWSGEPFRLGKGAAARHDYRFYAPGGNHGSNIAQLVADERAKATAEVLKWAGVAPQAVQKDEKAAKPLAPFDAKLDRVKNDKQSALRP

SEQ ID NO: 43989 - protein, 23 aa, Streptomyces mobaraensis
  Streptoverticillium mobaraense
  MOD_RES (7)..(7): Any amino acid
  MOD_RES (12)..(12): Any amino acid
ADSTSGXRAPSXTKVTGDGAVTF

SEQ ID NO: 43990 - protein, 20 aa, Streptomyces mobaraensis
  Streptoverticillium mobaraense
DIPIGQKMTGKMTYYTDKGY

SEQ ID NO: 43991 - protein, 682 aa, Streptomyces nanchangensis
MTASASVTVPVPALPSGVDSAWLPPEVFRPLGSRRTLILGTGPLVDTVHGEVADACARFGGDVVRDARAQGAPYDLVLELGRQSEEEDGLGDEGFALVRAEGVTRVTAAGQAGLLYGLFHLVRLGEAAFEGERARETHRPALALRMLDHWDNVAVHPVMGQVERGYSGGSLFWRDGLARGSRDELERVRCYGRLLAASGINAVTVNNVNVHETEAHLLTDRIGEVAAIADALRPYGIRTHLSVSFAAPVVLGGLPTADPLDAAVADWWAETTGRVYAAIPDFGGYVVKADSEGQPGPFTYGRSHADGANMLAAALAPYGATVHWRAFVYNHRQDWRDRSVDRARAAYDHFAPLDGQFAPNAVLQVKHGPMDFQTREPVSPVIGALPNTRLAVEIQATQEYTGQQKHVCWLGPMWSDALRFRRGGEDGPSVGDLVRGGGLAAVSSAGDDPFWTGHPLAQANLYAVGRLAWQPDADPRAILHEWIELSFAPEETADPARLRSGLRAVLDGSWRTYEKYTAPLGIGFMVQPGHHYGPSVDGYEYSPWGTYHFADRDGVGVDRSQATGTGYAGQYAKPWAETYESPETCPDELLLFFHHVPYGHVLHSGETVIQHIYDTHFEGVEEVEEARQVWAGLADLVDAARHTRVAERYEEQLRSAREWRDHINTYFFRKSGVPDARGRRIY

SEQ ID NO: 43992 - protein, 781 aa, Streptomyces olivaceoviridis
  Streptomyces corchorusii
MLSPTRHPSRHRARPALLGAAAAVAGLLLAGLPASVSHAAGQESCRPDGLYRTPGVDVPYCSVYDEAGREKMGADHQRRVIGYFTGWRTGKDGTPAYLAPDIPWDKVTHINYAFAHVDGGNKLSVGADTAANPATGMTWPGVAGAEMDPALPYKGHFNLLNKFKKQHPDVKTLISVGGWAETGGYFGADGKRVDSGGFYSMATNADGSVNRAGIDTFADSAVAFVRKYGFNGVDIDYEYPTTMKDAGNPLDWSISNGRRAGLVKGYAALMKTLRERLDRAGAADGKHYLLSVAAPSSGYLLRGMETFQVQKYLDYVNIMSYDLHGAWNEYVGPNASLFDDGKDAELAAAGVYSTSQYGGIGYLNTDWSYHYFRGSMPAGRINIGLPYYTRGFKNVTGGTDGLWGRAPATTCPAGSGLTKCGDGASGIDNLWHDLDTNGKESPAGSNPMWHAKNLEKGVVGDYVTKYGFPADTRLTGTYARKYDATLVAPWLWNAEKKVFLSTEDEQSVNAKADYVVDRGIGGTMVWELAGDYRWNAAKGQYEPGSTLTTAMYEKFKSATPYGAKRTTVDLPTEALDIGVDFGQFPLGDSNYPISPKLRITNNTKTTLPGGTEFRFDYGTSAPGNAKDQSGWGTSVIRSDHTGGNVGGLKGDYHRVSLKLPAWQSLAPGASAELDFVYYLPVSTPSNWTVTFGGKTYALAGDLARGTTVVEPGGGTGGPSPSPTPTDGTGTCADPAWTATKEYTGGSVVSHKGHTFLARWWTKGEEPGTTGEWGVWQDLGAC

SEQ ID NO: 43993 - protein, 296 aa, Streptomyces olivaceoviridis
  Streptomyces corchorusii
MPRRRTSALLAALVISTAAPVLLPAAPAAAAACSSYPSWVAGRSYAAGDIVRYTDGKAYIAEHANPGYDPTISTWYWEPYACDGGSGTPVGTFVVTEAQFNQMFPNRNSFYSYSGLTAALSAYPGFANTGSDTTKKQEAAAFLANVSHETGGLVHVVEQNQANYPHYCDWSRPYGCPAGQAAYYGRGPIQLSWNFNYKAAGDALGIDLLNSPWLVERDSAVAWKTALWYWNTQTGPGTMTPHNAMVNGAGFGQTIRSINGSLECDGKNPAQVQSRVNNYQRFTQILGVSPGGNLYC

SEQ ID NO: 43994 - protein, 864 aa, Streptomyces parvulus
  subsp. citrinus
MKRYFERPSIARLGALILALCLGIGLLSAPSYAALSRPIQKSDGERAHEGIPPQASLHAALGEDPEHVHGKPLPVEERAPLSSATDVVRRDYDSPVSSPPFKRPSMNESSDRKAAGKGKGAAAGCSPADFTSRSGSSLVKQVKTSTTECIDTLFDLSESNAQRAFREDRMTSVAYALRDGSAAYPGDSSTGMTQLLLYLRAGYYAHWHDEATVGAYGPKLRTAVRAGLDAFFASPRSQDVTDANGEVLAEAVTLIDSSEENARYLYVVKRLLKDYNSTYDSSWWMLTAVNNVHTVLFRGHQVPGFVTAVSSDRSVLKALYGFASSHKNLLGTDRSYLASNAGRELARFLQHTATRETTRPQVAALLAKSSLKGTTAPLWVGLAEMTESYDKSKCSLYGTCNLQQRLASSVLVINHTCSASLRIRAQEMTSAQLASTCRSLADQDAYFHSIAKDNGPVAGDRNTSLEVVVYNSSTDYQTYAGADWGINTNNGGMYLEGNPSAAGNQARFIAYEAEWARPDFEIWNLNHEYTHYLDGRFNMYGDFNANVSTPTIWWIEGFAEYVSYSYRNLRYDAAITEAGRRTYALSTLFDTTYSHDSTRVYRWGYLAVRYMLQSHRAELDTVLGYYRTGNWNTARAYLTGSIGTRYDSDWYNWLSRCAAGDCGGSTTPGNQAPTAAFAVSVSGLTANFTDRSTDSDGTIASRSWSFGDGTTSAAANPAKTYTAAGTYTVTLKVTDDKGATSTATQSIAVGGADATPECTSSDGRELGRNCKRSNLSATAGNYAYLYIYLPAGVQQLKVTSSGGTGNADLYYSNSTWATTSSYTSRSTGAGNSETLTITNPPAGWNYISLAAAADFSGATVKTEY

SEQ ID NO: 43995 - protein, 145 aa, Streptomyces platensis
MRYITGAVALGAALVLGTLATTAQAAAPAQPARTGGLYAPTELVLTVGQGESRATATVQRAVTLSCMPGARGSHPNPLGACTQLRAVAGDFNAITAATSDRLCTKEWNPLVVTADGVWQGKRVSYSYTFANRCEMNIDSDTVFNF

SEQ ID NO: 43996 - protein, 313 aa, Streptomyces plicatus
MFTPVRRRVRTAALALSAAAALVLGSTAASGASATPSPAPAPAPAPVKQGPTSVAYVEVNNNSMLNVGKYTLADGGGNAFDVAVIFAANINYDTGTKTAYLHFNENVQRVLDNAVTQIRPLQQQGIKVLLSVLGNHQGAGFANFPSQQAASAFAKQLSDAVAKYGLDGVDFDDEYAEYGNNGTAQPNDSSFVHLVTALRANMPDKIISLYNIGPAASRLSYGGVDVSDKFDYAWNPYYGTWQVPGIALPKAQLSPAAVEIGRTSRSTVADLARRTVDEGYGVYLTYNLDGGDRTADVSAFTRELYGSEAVRTP

SEQ ID NO: 43997 - protein, 333 aa, Streptomyces pristinaespiralis ATCC 25486
MPHPKPHRAYGAAVSAALSAALAATALVGAAPQAAAAPADATPSLRVLTYNAFLFSKSLYPNWGQDHRAAAIPAAPFFQGNDVVVLQEAFDNSSSDALLRGAAAQYPHRTPVMGRSKDGWDATGGAYSSTTPEDGGVAVLSKWPIVRKEQYVYKDACGADWWSNKGFVYAVLDVNGTRVHVVGTHAQSTDPGCDAGEAAEMRSRQFRAMDAFLDGKNIPASEQVVVAGDFNVDSRTSEYASMLADGGLVGADARTGHPYSFDTSENSIAAERYPDDPREDLDHVLHRAGHAKPSGWTNEVIKERSAPWSVSSWGTTYTYTNLSDHYPVIASGR

SEQ ID NO: 43998 - protein, 359 aa, Streptomyces pristinaespiralis ATCC 25486
MRRTLRARICLPALLALTAVGLGSSTAGAADAADTGGNPSPGVAASPAQYSLHTSLERDLGDRTAGSYFDTASGELVVTVIDDEAAEEVRATGARAQLVTRSMAQLRAAMDTLESKAKITGTSWGIDPSTNKIAVEADSTVSPASMAKLRAAAARLGDAVSIKRVAGEFKKEVAGGDAIYGGGYRCSAAFNVSKATTRYFLTAGHCTNSASSWSATSGGPAIGTREGTSFPTNDYGIVRYTDGSQPAGNVNLYNGSHQDITSAADAIVGQSIRKSGSTTKLTSGTVTAVNVTVNYGDGPVYNLVRTTACSAGGDSGGAHFSGSTALGIHSGSAGCTGTNGSALHQPVKEALSAYGVAVY

SEQ ID NO: 43999 - protein, 303 aa, Streptomyces pristinaespiralis ATCC 25486
MTRVVLFGAPIAVAVSVYFGGGGESQRPKDDPSLRVSPTAFAPDPLKAGSPAQQRERDDRIDALPAGLADPAKKEIAARLVASAENSTLDWKSQYGAIEDIGDGNGYTAGIIGFCSGTNDMLQLVEYFTREHPDNPLARYLPALREVDGSDSHEGLGAPFEAAWAKAAEDPEFRRAQDVMRDRIYFDPAVRLAKMDGLSTLGQFIYYDAMVLHGPGLGQDGFYGIREAAMKSADTAAEGGDEKAYLNAFLDAGRTVIGRQKTEQTRDSSRIDTAQRVFLREGNMDLDTPLTWRVYGETFRIGS

SEQ ID NO: 44000 - protein, 145 aa, Streptomyces pristinaespiralis ATCC 25486
MRYIARGLALAATTTLALVAAPAVGSAHTAQPGPERLYPPSALVLTVTTGDDATAGTVLRAVTLSCTPTATGTHPAAKAACAELRAAEGAFDAITTRDPSVVCTKQWDPVTVTVDGVWNGTRVEYAHTFGNSCIRSSGSGVLFDF

SEQ ID NO: 44001 - protein, 380 aa, Streptomyces pristinaespiralis ATCC 25486
MRRMTAIRTGLSALLLLGSWAAVGAGPAAASVPDAEPKLSTGLLGAMQRDLGLDADEATARLAAEKTATAVEGKARRAAGAAFGGSWFDADTGRLTVALTDAGKARAVRATGADTALVRHSARQLDSVKSEIDALKAPAGVASWHVDPEANRVVVNVVASERDDNDVRAFLDRARDAGPITVRETAQAPTPFAAGTVGGDPYYTGNVRCSIGFSVHGGFVTAGHCGRAGATVRGWDGTHIGTFQGSSFPGDDYAWVSVGSGWWTVPVVLGWGTVPDQLVRGSAEAPIGASVCRSGSTTHWHCGNVLAKNETVNYSQGAVHQMTKTSVCAEPGDSGGSFISGDQAQGVTSGGWGNCSGGGQTWHQPVNEILGRYGLRLHTA

SEQ ID NO: 44002 - protein, 432 aa, Streptomyces pristinaespiralis ATCC 25486
MPAHTVAPTAVRRVTARAVLDSRGNPTVEVDVVLADGSLGRAAVPSGASTGAREAVELRDGDPRRWHGRGVDRAVAHVKGEIADAVTGRDADDQAGLDAALVALDGTPTKARLGANALLGVSLATAKAAAVSHRQPLYRYLGGADARVLPVPMMNIVNGGAHADNPLDFQEFMIAPVGAESFAEAVRMGSEVFHTLRRDLLAAGHSTGVGDEGGFAPALRTAEEALDFVMAAIERAGYRAGADIGLVMDPASSEFYRAGVYAYVGEGVQRTPAEQVDYLAKLIDAYPIVSVEDPMAEDDLDGWRELTARVGDRCQLTGDDVFCTNEALVREGIRTGVGNAVLIKVNQIGTLTEALGTVNAARRAGWVAVMSHRSGETEDTTIADLAVATGCGQIKTGSLSRSDRTAKYNQLMRIEEELGASAVYGCAAASAE

SEQ ID NO: 44003 - protein, 474 aa, Streptomyces pristinaespiralis ATCC 25486
MPPGISPEHRGRTGPLGRAVRVVAGAALLLGLTAVPAAEAGEPGHCARQQTLRVPGAGHQELSCLDELTTAGTIASGHTDQADWAGLTPAGLATPSGVPGIQIDGYFPDDSAGNTNHGWNHDSQFVIRLPDRWNGGLVIAGSPGVREQYANDRAVSDWVLSRGYAFAATDKGNTGAAFHRDGRRPGEAVAEWNDRVTQLTRAARAVVAQRYHRPPRHTLATGMSNGGYLVRWQLENHPELYDGGVDWEGTLWRTEGPNLLTFLPPALRSYPVYAAGGVGAGQAHREMVAAGYPAGSEFLWPFHHQYYWDLTQRIYREELDPAFDGATEAGTPFCAPGTPACDADYDYASRPPEVHRAVDRIALTGRIGKPLITLHGTLDVLLPIGEGSDVYARMVREAGRDSLFRYYRVEGGTHVDSLYDVFPDRLRPLTPCHRSAFTAMEEWIGQDRKPAAGHTVAMPGAGDDPLTECSLGRG

SEQ ID NO: 44004 - protein, 444 aa, Streptomyces pristinaespiralis ATCC 25486
MADFGADPGNLNMYVYRPASLAPDPALVVALHGCTQSAQVYADNSGLTTLADRHGFLVVLAGTTSANNANSCFNWFQTSDNRRGQGEAASVRQMVAHAESAYGADAGRTFVTGLSAGGAMTSVMLAAYPDVFEAGAVIAGMPYDCTRDTGPFVCMNPGTDRTPAVWAQRVRDAYPSYTGPWPRVAVWHGDNDSTVAPMNAAELRDQWTAMHGIDQTPDRTSTIGANGTRREQYLDGSGKVAVEVDRVPSIGHGTPVDPGSGPEQCGRTGTAHFIDSICSSHWVAGFFGLAGGDPDPGGLPAPAGLTVTGSDDTSIALAWQAVDGASDYAVYRDGTRVATPLGPSFTDTPLAAGSTHAYRVAARDAAGTEGARSAQITASTTGAAAVCWTGSNYAHVRAGRATTTGGYTYAKGSGQNMGLYNTFVTHTLKESPAGHYVIADGNCP

SEQ ID NO: 44005 - protein, 305 aa, Streptomyces pristinaespiralis ATCC 25486
MKIKRFAPLTGVSRAARLTAVAAALVTVSALAAPSALADQADSARATTAQLAQVDDAVLGADVAGTAWYTDKETGKVVVTADSTVSAAEIAKIKKAAGERAGALEIKRTPGTFNKLIAGGQAIYAGGGRCSLGFNVRSGSTYYALTAGHCTNIGSTWYTNSANTTVLGTRTGSSFPNNDYGIIRHSNASAADGRVYLYNGSYRDITGAGNAYVGQTVQRSGSTTGLHSGRVTGLNATVNYGSGDVVYGMIQTNVCAEPGDSGGALFSGSTALGLTSGGSGNCSSGGTTFFQPVTEALSAYGVSVF

SEQ ID NO: 44006 - protein, 361 aa, Streptomyces pristinaespiralis ATCC 25486
MKHRRIPKRKAAIAGGAVVAVVAAGVTFQSANASDHTAQFDVKALTAPAAGNLAATLRADLGAEEAGAYYDAKAKALIVNVLNEDAAQTVREAGGKARIVENTLVELKSARQTLTDKATIPGTSWATDPVTNKVVVTADRTVEGADWAKLQKVVEGLGAKAELKKTAGEFRPFIAGGDAIHSGGGRCSLGFNVVKDGEPHFITAGHCGQTGSEWSDSAGGPAVGTMVDSQFPGNDFALVKYSGATEHPSEVNLYDGGSQAITQAGEATVGMQVTRSGSTTQVHDGEVTGLDATVNYGNGDIVEGLIQTNVCAEPGDSGGSLFSGDAAIGLTSGGSGDCSSGGETFFQPVTEALSVLGAEIG

SEQ ID NO: 44007 - protein, 300 aa, Streptomyces pristinaespiralis ATCC 25486
MRIKRTIPRTRTTARRTRLLAVATGLTAAAALAVPTASAEETQTFSTHQLTAASDAVLQADVPGTAWHVDQATGTLVVTADSTVSRAEIAKIKREAGTNAGALRIERTPGTFSKLISGGDAIYASSWRCSLGFNVRSGSTYYFLTAGHCTDGAGTWYTNSSRTTSIGPTTGSSFPGNDYGIVRYSNTSLSHPGTVGGTDITSAANATVGMSVTRRGSTTGTHSGTVTGLNATVNYGGGDIVYGMIRTNVCAEPGDSGGPLYSGSRAIGLTSGGSGNCSTGGTTFFQPVTEALSRYGVSVY

SEQ ID NO: 44008 - protein, 344 aa, Streptomyces pristinaespiralis ATCC 25486
AAPGGAGDGWRCGGSDPSVPRSCASGPREPLSLAVHVRNTPSWPAPHGPATAGSSPLPRRSTVRIKRTRALLAAGAALAVTAAVAPSTAQATPSPGPAQLARADAAVLAAGVEGTAWYVDRTLGRVVVTADSTVSDAEITGIRSAAGADAGAITVKRAPGVFKPLLGAGDAIYGSGYRCSLGFNVRSGSTYYFLTAGHCGDVAPTWYANSAQSTLIGPTVGSSFPSNDYALVRYDNASLSHTGGFTAADAYVGESVKRSGSTTGTHSGTVTALNVTVHYSGGGTVRGMIQTNVCAEPGDSGGALYDGTKALGLTSGGSGNCSTGGTTFYQPVTEALAKYKVSLY

SEQ ID NO: 44009 - protein, 218 aa, Streptomyces pristinaespiralis ATCC 25486
MRHTRTLFSAVVGLGLAAVLGTVPATAANSPAAAVTSSSTSYAAYEGSAEDAKATRAFFDAVVRSVAQKRAANPGAQAVTVVYNASNAPTFRTQIARSTQIWNGSVSNVRLVEGSGADFAYYEGNDSRGSYASTDGHGRGYIFLDYRQNQQYNSTRVTAHETGHVLGLPDHYSGPCSELMSGGGPGTSCQNAYPNSAERSRVNQLWANGLAAAIAKVS

SEQ ID NO: 44010 - protein, 360 aa, Streptomyces pristinaespiralis ATCC 25486
MRRLVPQALVVAFLAGGTSAFVADDKAVRLTVDGVPRTLHTFADDVRELLEDQGLDLRAHDVVAPGPAADLDSGDEITVRHGRPLRLTLDGRPVRVWTTATTVEAALRELGVRAEGAYISVPRSARIPRAGLALDVRTERAVTFMADGRERTIRTNAATVGEALAEAGIALRGQDTTSMAPGSFPRDGQTVTVTRISGGREVREEPIAYTVEKTLDPELFTGTEVVVRQGRPGVRRVTYALRTVDGVRQKPRRTGADVVRAPVTEQVKVGTRQPPSSVRGADDLNWAALAECESGGRPGAVDPSGTYGGLYQFDTATWRSLGGTGRPQDAPAEEQTYRAKKLYVQRGASPWPHCGRRLYR

SEQ ID NO: 44011 - protein, 418 aa, Streptomyces pristinaespiralis ATCC 25486
MAGTGRHRRYQPSRINRASLTVTAGGAGIALPLVGAGSSHAASVDVWEKVAACESTDNWRINSGNGYYGGLQFSQATWEAYGGRQYAPRADLATKDQQIAVAEKVLEAQGPRAWPTCSVKAGLTRGGDAPEITQPRPQEAAAPKRIAPKAAASPTTVPTQREGYTVARGDSLSRIARSERVEGGWQQLYAQNRTVVGDDPDLIFPGQRLTLRGKAAPQQDRRTATTARPDRPAEKVRPEAAPKPAPKTAPRTRPAPKPAPAPKPKTAPRPASKPAPAQKPRTEAASFAAPVAAGPSTAYRKTGSSWSSGYHTGVDFAVPTGTSVKAVASGKVVSAGWGGAYGYEIVIRHSDGRYSQYAHLSALTVRAGQQVSAGQRIARSGSTGNSTGPHLHFEIRTGPGYGSDIDPLAYLRARGVSV

SEQ ID NO: 44012 - protein, 369 aa, Streptomyces pristinaespiralis ATCC 25486
MQNTCNGAAAQTWKLAVSGSGYTLTAAHSSKCAGVRDASTSAGKPVEQQSCSSTATQVWKLTQVSGDTYQVVNGNGAKCLNVKDSSKAAGALVQQNSCDSVTSKKWTLTASGTVPTDPPTDPTDPPTDPTDPPTDPTDPPGSWPTANGSQAVSSTISVTGTYDGGMKRLYGSGDLGSDGQSESQPPMLRLADGATLQNVILGAPAADGVHCDGTCTLKNVWWEDVGEDAATFRGSSSSTVRTVEGGGARKAADKVFQHNGAGTLIIKNFQVQDFGKLVRSCGNCSTQYARHIQVLDTVVTAPGDTLVGINTNYGDTARFSGITIHGDSGRDIDICTKYRGTTSGEPTKIGTGADGTHCLYTSSDIRYAD

SEQ ID NO: 44013 - protein, 289 aa, Streptomyces pristinaespiralis ATCC 25486
MDGDTGTTGKLPETTATGAAPDRRPSRKTVLRAALAASVAAPIALMGVPALARTASVTGEAPALTPECDDGDDPTPPQMEGPYFKPNSPRRSSLLEAGTPGTRLTVSGYAFGSACLPLSGVLLDFWQADVNGAYDNVGFRFRGHQFTDARGAFSLTTIVPGLYPGRTRHLHVKVQAPGRPVLTTQLYFPNEPRNSTDALFDPRLLMTVRDTGGAREAAFDFVLNVPQTPGPGPTEGPTTPPPGGTWAVGTSYAPGVRVTYGGVTYVCLQGHQAQPGWEPPSVPALWRAE

SEQ ID NO: 44014 - protein, 790 aa, Streptomyces pristinaespiralis ATCC 25486
MAGDTGDPHQEELIVQSPTRTRAGASLLAAGAAAAALLAGMVSPGVSHAASQENCRPDGLYATPGVDVPYCSVYDTEGREKMGADHQRRVIGYFTGWRTGKNGQPAYLASDIPWDKVTHINYAFGHIDSANKLSVGADGEKNAATGMTWPGVAGAEMDPALPYKGHFNLLNKFKKQHPDVKTLISVGGWAETGGYFDDNGVRVNSGGFYSMATNADGSVNQAGINTFADSAVAFIKKYGFNGVDIDYEYPTSMKDAGHPADFPVSNARRGGLNKGYAALMKTLREKLDRAGAADGKHYMLTVAAPSSGYLLRGMETFQVQKYLDYVNIMSYDLHGAWNEYVGPNASLFDDGKDAELASANVYGSAQYGGIGYLNTDWAYHYFRGSMPAGRINIGLPYYTRGHQNVQGGTDGLWGKAAATSCPAGSGLTKCGDGAVGIDNLWHDKDDNGKESPAGSNPMWHAKNLEKGIVGDYVTQYGFPANTRLTGTYVRKYDSTLVAPWLWNAEKKVFLSTEDEQSVAAKADYVVDRGIGGTMVWELAGDYDWNAAKGQYEIGDTLTTSMYEKFKAAAPYGAKKSNTPLPTEAVDIAVDFTEFKLGDSNYPITPKLRITNKTSATLPGGTEFQFDYATAAPANASDQSGFGTKVIRSDHTGGNTGGLKGDFHRVSLKLPAWQSLAPGGTVDLSFNYYLPVSTPSNWTVNIAGKAYALAGDLGRGTTLVEPGSGSSPSPSPSEPGTPGACTAPAWNATSEYGGQVTVSHASHQWKSKWWTKGEEPGTTGEWGVWQDVGAC

SEQ ID NO: 44015 - protein, 277 aa, Streptomyces pristinaespiralis ATCC 25486
MKSVLRALLASLIAVAACTACTGDGSGGGSGRGLEDPAKKDIAMRIVSSAENSSLDWKAQYKYIEDIGDGRGYTAGIIGFCSGTGDMLAVVERYAKARPGNALERFLPALRAVEGSDSHEGLGKPFTRAWQRAATSDAAFRTAQDAERDETYLLPAVRRAEQDGLGALGQLIYFDAYVMHGADASESSTGFRALREKALAGAEPPAEGGDEEDYLNAFLDARVAAIREEPSHSDTSRVETAQRVFVRERNFDLEPPLNWRVYGESYRIGASAAPPAG

SEQ ID NO: 44016 - protein, 239 aa, Streptomyces pristinaespiralis ATCC 25486
MLHLRPLSGDTRMSHPTPPPYGQQPHQPGHGYPQYRQTQPYQQPYAGGPAPYQPPPPPKKGMNGWAITGITLGGVFVFLIVLGALVGGDDSGTGSSGKPDTRAAAPEKPAAADPKSAEKAKDEPAAQPAPESPVKVTATKTRFAPSILHDGGAYTSVKVTIANNSEEKIDVNPLYFSITATDGSKHTAELGVDEHQIDTVDLAPGEKITGTITGEGAFTPKYVTYTDGLFGDDVRGNVS

SEQ ID NO: 44017 - protein, 290 aa, Streptomyces pristinaespiralis ATCC 25486
MSPDRRTKSPFGPLPRRKSLLTTGAVASIALVFAGFGSPAVAAMQYVPSASVAGAYGDDECKPGKDDYPRALLEELREMGVPGVDGHDDKCKGKVGPTGPTGPTGPTGPTGPGGDGQTGPTGPTGPTGPTGPGGGEPGATGATGPTGPTGPQGEPGPCQDTDAYNPSNAQEVKAVLTGGTTYAGIRNLQGQSGLDFTWYNLSDTDSDYPADACSVAIASQANGVSIQVLTRGGVVWETVCDVVGGNPFALSCDEDWEPLATQPLTDAEANNRALSKLSGTDPNYRAKGMK

SEQ ID NO: 44018 - protein, 619 aa, Streptomyces pristinaespiralis ATCC 25486
MASGFSQRVQVSDKCFLAQIGLVLIWCRPLTWASGCGYHCCNSRTTHPPRRPHVHVRRPLLAALTSAALAAGALAAVVGPGSAQAADTAPAAASTGGVKIAYYDQWSVYGNAFYPKHLDTRGIADKLDVINYSFGNIHPTELTCFEANKAAGDDANPNAGDGAGDSYADYQRSFSAADSVDGVADTWNQPIVGVFNQFKELKAKHPHLKINISLGGWTYSKYFHDAAKTDASRKKFVASCVKQYIAGDLPVEGGYGGPGTAAGIFDGIDIDWEYPGSPDGHLGNHYGPEDKQNFTLLLAEFRKQLDAYGAAHGGKKYLLTAALPAGQDKIRHIETDKIGAYLDYANIMTYDMHGAWDGDGPAYHQSPLYSPASDPTDPVKPGTQKYSIDNAIDAWLDGNSAYGIAGGFPAGKLTLGYEFYYRGWKGVPAGTRNGLGGSATGASAARPVSQQAGIAHYKELGGIVDNPATTFWDDEAKAAYFYKDGEFFTGLDRRAIQARADYAHERGLGGAMMYSLLGLDAQATLFHQIVTAVGSSPTDPEPTPTPTEPTPTPTEPTPTPTPTEPQPGCTAAAWTSTAVYNNGGEASHKGRLWKAKWWTQGEEPGTTGEWGVWQDLGAC

SEQ ID NO: 44019 - protein, 428 aa, Streptomyces pristinaespiralis ATCC 25486
MPSIDVVVAREILDSRGNPTVEVEVGLDDGSTGRAAVPSGASTGAFEALELRDGDQNRYQGKGVEKAVLAVIEQIGPELVGYDATEQRLIDQAMFDLDATPDKSSLGANAILGVSLAVAHAASEASDLPLFRYLGGPNAHLLPVPMMNILNGGSHADSNVDIQEFMIAPIGAESFSEALRWGTEVYHTLKKVLKQKGLSTGLGDEGGFAPNLDSNRAALDLILEAIKEAGYAPGKDIALALDVAASEFYKDGSYEFEGKARSAAEMTEYYAELVDSYPLVSIEDPLFEDDWAGWQTITEKLGAKVQLVGDDLFVTNPERLARGIDEGAANALLVKVNQIGSLTETLDAVELAQRNGFKCMMSHRSGETEDVTIADLAVATNCGQIKTGAPARSERVAKYNQLLRIEEILDDAAVYAGRSAFPRFKYEG

SEQ ID NO: 44020 - protein, 227 aa, Streptomyces pristinaespiralis ATCC 25486
MLRSSGNAKHRRASRATRIAAFVGITGAAVAAPLLGAGTASAATASEWDAVAQCESGGNWSINTGNGYYGGLQFSASTWAAYGGTAYAATADQASKSQQIEIAEKVLAGQGKGAWPSCGVGLSSASYDGGSAEAEPTQPAQQRAEAPTTRSERTEAPAPAKQAEKPAAKAKSFKKGDGEYKVKAGDTLSKIAEAEKVKGGWEKLFELNKDIVEDADVIHPGQQLHLS

SEQ ID NO: 44021 - protein, 268 aa, Streptomyces pristinaespiralis ATCC 25486
MSQYTQPQPQPGQFAAPAPARNGLGTAALVLGIIGLVFAVIPFLFWIGTILGLLALILGIVGRGRAKRGEATNKGVALAGTVLGLVGIIVSVIIGIVTVMAVDDAVDEINKAVENTAPKDTTAGGTDGAAEGDAPKDETKSLAADETSAYEDNVEVTVSAPKPYTPGEFAIGHTKGNKAYQVTITIENAGKEKFDTSLVTADARAGKDGVTAEQIFDDKAGTGFEGTILPGKKATVTFAFDAPADAKNLTVEVSPGFDYDASQWELTL

SEQ ID NO: 44022 - protein, 453 aa, Streptomyces pristinaespiralis ATCC 25486
MLHRHAKAACVGAAAAAALVLTSLQGAASAQPAGGAAPSAANTLAVSAAQPELLRAMQRDLGLTRAEAERRLVNEAEAGATAAVLRQRLGDSFAGAWVEGADSGTLTVATTRAADAAAIRAGGAEARTVTHTLAELDRAKAALDRAAARDSSTDVPVWYVDVRANAVVVRAVERSAAQTLIGASGAERDLIRVVPTEEQPRPLYDIRGGDAYYMGGGGRCSVGFAVTRGTTQGFATAGHCGRAGTSTSGYNQVAQGTFQASTFPGRDTAWVAANSNWTSTPYVKGQSGQNIQVTGSVQQPVGASICRSGSTTGWHCGTISQHNTSVTYPEGTITGVTRTTVCAEPGDSGGSYISGSQAQGVTSGGSGDCRSGGTTFHQPINPLLQGYGLTLKTTTDPGEPGEPGEPGGTWAAGTVYQAGAQVTYGGVTYRCLQGHQAQAGWEPPNVPALWQRL

SEQ ID NO: 44023 - protein, 269 aa, Streptomyces pristinaespiralis ATCC 25486
MSRHKRSLRRRRTVAALGAALGLTVTGIVTTSMLNTAGAATAWPKPNGSSAVNATIEVSGTYDGGLKRFYGSGDLGDGGQGEGQPPIFKLKDGAVLKNVVLGSPAADGVHCMGSCTLQNVWWEDVGEDAASFKGKSASSVYTVYGGGARKASDKVFQFNGAGKLVVTKFQVSDFGKLVRSCGNCSTQYKRSVIVNDVDITAPGKSLVGINTNYGDTAALRNVRIHGDSSRKIKPCIRYTGNDSGDEPVETGSGPDGTYCRYSSSDISYD

SEQ ID NO: 44024 - protein, 793 aa, Streptomyces pristinaespiralis ATCC 25486
MFQSGKPRRPLRPFARGSLRAALITAATALTLCVTAVQPAPAAEPTSGAPAAPSAIRPASAPNPTDRVDRLSKAPDRAALPLPAPGGLTGGRVPGPRTPERKGGAKAQHAALGAAAVPCTLDGVTGLPPERFADFLADPAVTADGCLRSVLWTWDRRLVPVMSDAHVRTVSRRITALAAAHDGGNGSHLLEMFTYLHAVAYHDFSRDEIDITDAPTLNTMRRAVAAFGAAPRTFDATRTNAETLREALYAASAPGLRQYQLPLVKQVLATMDARHPDTAQDTSWAGAALAALSLNYLGVHPGNQDTAFHAAAKAAPSYRAAFRSFATHTHLKDRPNAWVVRDALSEYGRFGQIDGLRTGTVSGLGTLLGVTAQNFGDMSDPWAKVATWLGVYEACAPYRVCKSDIEKRLFPYTYVYGVDAVDRIKVRTGLARSTVDQLYYASKQVKAQFHRVVGSEEPLAGDPNSALDIVLYSSRKEYEIFHPLLTGMGTDNGGIYIEKGATFYTYQRRVPQDSSLTLEELFRHEYGHYLNGRWAVPGFFGEGPWYEGDRTTAMDEGTAEFFAGASRSDGVKVRRSLVQGVIDDTANGGPRMSVDRLLHATYDGDGFRFYDYAGTFFEFLWTQRPSLLRDMYRTLRADDPAAFDAWRDRLGKDAGLQSAYDAFLDAQIAHVDDLFVPDTAYVPLDQLRDGSADEVRASFAATTGSTPACRGSGTTERPRFVCTGRVTAHLTDAGDADLVFKDMSETVDHFLLDRAAGGDNNLIDMNCSFDEVDIWSGGRAGTSDYSCEGPLRG

SEQ ID NO: 44025 - protein, 862 aa, Streptomyces pristinaespiralis ATCC 25486
MSSGKRFPAEPWSVQVEFSRRSVLSVIPAATLLAVAQPLRARAAPRALPSSGQAADHALLLRNTVAVFAGTEEANARPEVAPKVAAIASTARSRLAAMDDAGPGELFAGVPLGTSDPNLSRTFQYLYEIALATRTPGASGLPDGSAVRRRVADGLVRLHDEYYGDQSKGYYGNWFNWEIGIPAHATKTLVLLGDELAAYRPDLAATYIASMDAYLRNGKDGDVDLDSRFHTGANLADITTNRILQGAVLGDDARVSKAVADQLTVFARIDPYDLRHGVTDGFYADGSFVQHASVAYTGSYGKGLLTRIVQSVKILDGTAYVPSESLVGVVQGWVAEGFAPVIFEGWMMEIVKGRAVSRTGTGYADVAAVVEAVVDLAGYATGDDAQALEGYVKYVRQTSRASLDPVTFVSPVSIARYAGILNSPAPAKDLVRRLSAHMLVGPPQSRTALSWWLALARSSDRISKYEYMSGENLMPWFQGDGAHYLYLSGQDQRQAFGVDYFTTVSPYRLAGVTAPVEDRRTVPELYGTLWYDNPGRGFTSSSESQNTYVYFPRGSHPHSGGARLGAYGSAALVLSDDVAYAAKEAGRLPDDFVAHQGARGTRSWFMLDDEIVVLSAGVTGGAGRAVTTTVDSRIAPPTAPVTVTGELHDGTPWQDAGTTPPAWLRYADAGQGTAVGYVFLSGPRPTVALDTVTRSLRGVRLSNPDTAVTKKVFTVSYELPSGAAPTAMAHAIVPNASERQLASYAGGPLSVLVNTVRVQAVKHTGLGLIAVNTFAAGVHHAERLSVDGPASVVLRRSPDGTCSIAVSDPTTGRRTVRVTLHGRALRAVSADDGVRTTHVPGGTRIDVTTHHAYGRSFTATLR

SEQ ID NO: 44026 - protein, 322 aa, Streptomyces pristinaespiralis ATCC 25486
AVDYAANSITVRADSTVSAGDWSRMTGLAEEIGGFVRMERTTGTFTTRVNGGTAVFGDQRRCTAGFNVTNGQDIFILTAGHCGPQDSTWFRDRQGDELVGTTTAASFPGDDYSLVRYEDVDVLDRTNVVDIGGGRGVQIVGAGEPAVGQRVFRSGSTTGFRSGEVTAVNATVNYPEGTVTGLIETTVCAEPGDSGGPLFSEGLALGVTSGGDGDCTTGGTTYFQPVTTAMEKLGVDLTGGPPAPGGAADESEGGAPPPPLPAPPRSGEGLGSRAVSSIVDFGSPALGAGLIGLSLTGLLAARWLVSAQERREYRDFHSASWG

SEQ ID NO: 44027 - protein, 412 aa, Streptomyces pristinaespiralis ATCC 25486
MPGRARECDAVRPGPCGAAVGQPESGRASGESGGGPGQGRRIETTAEQRLEVRDHAYGGGGVRVQRGKPQQQSLHGRQSRKDRYMTNRSPQVPTAARRSARSLFTVLLAAVLPLLSALLVAVAAPPASAASLTEVTAFGSNPSNLRMHLYVPDSVRERPAVLVAVHNCTGSGPAFHSGTQFASLADRYGFIVVYPSATRSGNCFDVSSPQALRRDGGSDPVGIRSMVAHVQQRYGADPGRIFVTGASSGAMMTNVLLGNYPDVFAAGAAFMGVPHSCFATTDGSGWNSACANGTVDRTPQEWGALVRAAYPGHTGPRPRMQIWHGTEDSTLRHPNLVEQIDQWTDVHGVSRTPAYTDRPQPDRTRTRYGATGSRAPVEAISVQGAGHTLPTSGMAADAVAFFGLDDTTPPPD

SEQ ID NO: 44028 - protein, 451 aa, Streptomyces pristinaespiralis ATCC 25486
MSSTTGFRIPAGGGELSHRRIPKRKAVLAGAGAVGIAAAAVLLPHANASQSGSGSGPEADPRTLSAAAAQDLVSELGPQLGDAYAGAYYDAQKQQVVVNVVGDSNSVIVQVNEAGAVARPVENSMGQLKAAADTLAEKAAVPGTAWAVDPRTNQLLVTADRTVAGDDWNRLESTVKSLGSGMARIQKSAGVFKPFLEGGDAIFGGGSRCSLGFNVTTGDGQPGFLTAGHCGVADDQWSEDPNGAPIGTVQAATFPGEGDFALVTYDDPATVAPGTVDLGNGQTLDIVGADDAAVGQEVFRMGSTTGLNSGQVTGLNATVNYPEGTVTGLIQTNVCAEPGDSGGALFTRDGAAIGLTSGGSGDCTSGGETFFQPVTTALAAVGAEITTGDGGDGGGAADQGQGQQQDGQDQGQGDQDGQDQQQEGQNQDGQDQQEGQNQDGQDQQQGGFDGT

SEQ ID NO: 44029 - protein, 268 aa, Streptomyces rimosus
MRLSRRAATASALLLTPALALFGASAAVSAPRIQATDYVALGDSYSSGVGAGSYDSSSGSCKRSTKSYPALWAASHTGTRFNFTACSGARTGDVLAKQLTPVNSGTDLVSITIGGNDAGFADTMTTCNLQGESACLARIAKARAYIQQTLPAQLDQVYDAIDSRAPAAQVVVLGYPRFYKLGGSCAVGLSEKSRAAINAAADDINAVTAKRAADHGFAFGDVNTTFAGHELCSGAPWLHSVTLPVENSYHPTANGQSKGYLPVLNSAT

SEQ ID NO: 44030 - protein, 83 aa, Streptomyces rimosus
  subsp. rimosus ATCC 10970
MAQDVLGVHRSDRRPAGTGSWKAFQRCLKANWGYTGAIDGKVGSGTVKTLQRLLKHSWGYTGQIDGEAGKGTKAAFRRFANGI

SEQ ID NO: 44031 - protein, 45 aa, Streptomyces rimosus
  subsp. rimosus ATCC 10970
MGGAPGAHGAKGKDKDQNNGQRPDYLVEDEETWTTQRNVAPRVIE

SEQ ID NO: 44032 - protein, 113 aa, Streptomyces rochei
  Streptomyces parvullus
TAPASLYAPSALVLTIGQGESAAATSPLRAVTLTCAPKATGTHPAADAACAELRRAGGDFDALSAADGVMCTREYAPVVVTVDGVWQGRRLSYERTFANECVKNAGSASVFTF

SEQ ID NO: 44033 - protein, 326 aa, Streptomyces roseosporus NRRL 15998
MPNTVFRRLTGVALSAALATVTLAANAPQAAAAETPSLRVLSYNAFLFSKTLYPNWGQDHRAAEIPKTSFFQGNDVVVIQEAFDNGASDALLRNAAAQYPHQTPVIGRSKSGWDATGGSYSATTPEDGGVTILSKWPIVRKEQFVFKDACGGDWFSNKGFAYAVLNVNGTRVHVVGTHAQSTDPGCSAGEAAQMRSRQFKQMDAFLDAKNIPASEQVVVAGDFNVDGHSAEYASFLADAGLTTPDSRTGHTYSFDTRDNSIASERYPDDPREDLDHVLHRTGHAKPTGWKNDVIKEQSAPWTVSSWGKKYTYTNLSDHYPVIGSGQ

SEQ ID NO: 44034 - protein, 380 aa, Streptomyces roseosporus NRRL 15998
MRHATLLRTGLSALLVLGAWTAAGPVSASAAPAPAEPAASAALLSAMQRDLGLTEKQALTRLADEKAATTLEKKAQRAAGSAFGGSWLDAKTGKLTIAVTTAEKAEAVRATGADTRLVEHSAKSLDAAKARIDALKAPSGVSSWHVDPATSRVVVNVVAAEQTDNDVRAFVAKARKAGPVTVKTTAQAPQTFAAGTVGGDPYYTGNVRCSIGFSVHGGFVTAGHCGGTGQQVRGWDNSYIGNFQGSSFPGDDYAWVNVGSGWWTVPVVLGWGTVPDQLVRGSNEAPIGASICRSGSTTRWHCGRVLAKNETVNYSQGAVHQMTKTSVCAQGGDSGGSFISGDQAQGVTSGGWGNCTSGGETWYQPINEILNRYGLTLHTA

SEQ ID NO: 44035 - protein, 448 aa, Streptomyces roseosporus NRRL 15998
MAATGRHRRYQPSRINRASLTVTAGGAGIALPLITAASAGAASGEVWEKVAACESSGNWAINTGNGYYGGLQFSGSTWAAFGGTQYAPRADLATRDQQIAIAERVLDGQGPGAWPTCSVRAGLTRGGDAPETTPGTGTGTAPQSAGSRTAQAAAAPQSAPPRKAQTRPAATTPTHVPGKRDAYTVASGDSLSGIAADRRVPGGWQGLYAANRTVVGDDPNLIFPGQRLSLDGSRAPKAGQGTSTGKPARQTAPKPSATAPGAKKADRRQAEPEKEAPKQQAPKKEAPKQQAPKQEAPKEAAPKKEQPAPERAVRHSGFSAPVAAGTGTPYRQAGSWSSGYHTGVDFPVPTGTSVKSVAPGRVVSAGWAGAYGYEVVIRHSDGKYSQYAHLSALHVRAGQSVSGGQRIARSGSTGNSTGPHLHFEIRTGPGYGSDVDPLAYLRAGGVRV

SEQ ID NO: 44036 - protein, 426 aa, Streptomyces roseosporus NRRL 15998
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATENKASLGANAILGVSLAVAHAASEASDLPLFRYLGGPNAHLLPVPMMNILNGGSHADSNVDIQEFMIAPIGAESFSEALRWGAEIYHTLKKVLKTKGLSTGLGDEGGFAPNLESNRAALDLIVEAIKEAGYVPGRDIALALDVAASEFYKDGVYEFEGKSRSAAEMTEYYEELVSAYPLVSIEDPLYEDDWAGWKVITDRIGSKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAVYAGRSAFPRFKG

SEQ ID NO: 44037 - protein, 235 aa, Streptomyces roseosporus NRRL 15998
MLLNSKGKHRRPSKATRIATLAGVTGAAVAVPLMGATNASAASVETWDAVAQCESGGNWSINTGNGYYGGLQFSQSSWAAAGGTQYAARADLASKDQQIATAEKLLDMQGPGAWACAGAGGLTNDGVDPGVNPGGSGQSESKPEQAQPQRQAEQPTTRSEQREAPKAESKKTVTTPTGEKVKKGDGEYKVKAGDTLSKIAQKEGVKGGWSKLFKLNDDIVEDADLIFPGQQLHLK

SEQ ID NO: 44038 - protein, 397 aa, Streptomyces roseosporus NRRL 15998
MTHVRVPLGSRFDASVARCSRVTCAPTQARNPAAWRSGHSLVSRTEGIPMGSANGRHRRPRQAPAIVVAAGVTGSAIAIPLLGASGASAAEASTWDRVAECESGGMWSADLGNGYYGGLQLSQETWSAYGGTEFAPRADLASRSQQISVAEKVLDDQGPKAWPSCAVISGLAVDGSLPGVDPGTSPAPDPTTTPTDEADAPDEADESGKSGEADESGKGDKSGKGEKGDSADKGDSGDAEKGGEAPDSSATPTTPPPSGTPDATEPSTAPDDSQGKGGKHRGAPAPEEAESGQEDGPRGSGRHASRGDGDARDGGAATTGAYTVQPGDNLWAIANAQELPGGWTGLYETNKDLLGSDPDLILPGQNLDLGLERGQGEGADQVAPQGADESAEAPAAN

SEQ ID NO: 44039 - protein, 441 aa, Streptomyces roseosporus NRRL 15998
MNGLSTSQDGRLGAFHEQLTLGGGDRVWAHAPTMVDTPLVDAPLTELTPPPTVPRQGPTRAEARRAAKRRRAFVADPENLKLSRLVPRALVVAFLAGGTTAFVAHDKAVRLEVDGTPRTLHTFADDVTELLEEEGVTVGAHDRVSPGPGAGLDHGDEVVVQYGRPVTLTLDGVRHRVWTTADTVAGALREFGIRAEGAHLSAARSTRIARTGLTLTVRTERAVTFMADGQERTLRTNAATVREALAEAGITLHGQDTTSVAPASFPRDGQTISVMRITDTREVREETVPYAVERSEDPALFRGTEVVERAGRNGVRRVTYAVRTVNGVRQKPRRAAEELVHVPVSRVVRTGTRQRPDSVAGADGLNWSGLAACESGGRADAVDPSGTYGGLYQFDTQTWQSLGGSGRPQDAPAAEQTYRAKKLYVQRGASPWPHCGRRLTG

SEQ ID NO: 44040 - protein, 147 aa, Streptomyces roseosporus NRRL 15998
MRRNPHAIFATITAGTLLLGGFATATAQAAPAKAESLYAPSALVLTVARGEDPMTATVERAVTLACAPSAQGTHPDPAAACKELAAVQGKFAELAAGPSNRTCTRQWDPVVVTAHGVWQGKPVQFSTTYGNSCEMAGSMNDNAVFAF

SEQ ID NO: 44041 - protein, 784 aa, Streptomyces roseosporus NRRL 15998
MLSPTRARATLLAAGAAVAGLLLSSLAAGPSAAADQNSCRPDGLYQTPGVDVPYCSVYDADGREKMGADHQRRVIGYFTNWRTGKDGKDAYLVPDIPWDKVTHLNYAFAHVDGSNKLSVGPDSADNASTGMTWPGVEGAEMDPTLPYKGHFNLLTKYKKQHPNVKTLVSVGGWAETGGYFGPDGERVDSGGFYSMATNADGSVNQAGINTFADSAVAFIKKYGFNGVDIDYEYATTMKDAGNPLDHTLANGRRAGLVKGYDALMKTLREKLDRAGEADGKHYLLTVAAPSSGYLLRGMETYQMQKYLDYVNIMSYDLHGAWNEYVGPNASLFDDGKDNELAQAGVYTTSQYGGLGYLNTDWAYHYFRGSMPAGRINIGLPYYTRGFKNVQGGTDGLWGKAATTDCPAGAGLTKCGDGAVGIDNLWHDKDTNGKESPAGSNPMWHAKNLEKGIVGDYVTDYGFPANTQLTGTYARKYDATLVAPWLWNAEKKVFLSTEDEQSVKAKADYVVDKGIGGTMIWELAGDYQWNAAKGQYETGSTLTTAMYDAFKSATPYGAKRSTIDLPTQALDIDVSFGQFPLGDSNYPISPKLKITNRTQATLPGGTEFQFDYSTSAPANAKDQSGFGTTIIRSDHTAANNIGGLKGDYNRVSLKLPAWQSLAPGASVELDFVYYLPTSTPSNWTVTFGGKSYSLAGDLARGTTVVEPGTGTSPTPTPDPTGPTPTPTPTEPGGSCSAPAWNAATEYGGGSTVSHGGHEWKASWWTKGETPGSTGEWGVWKDLGAC

SEQ ID NO: 44042 - protein, 386 aa, Streptomyces roseosporus NRRL 15998
MSAGVATGAYAGTTEEPSAPAAAPAYQPEMVKALAVTLGVSEKAAVERLDREADQQDRFAELRKDRVDTLGAFFTKDGSLVVNAADAEAAKDVRAAGLKARVPERGESELDRIKAQLDAKALKSAPAGVSAWSVDLASDTVTVEVNGDTDAATRSFLKAAQSNGDAVRVVKGQEKLETQAVVPPGSRMTFNGYLCSVGYGAKDRNGKQVLVTAGHCIEDLPELAYNGTRFAKGTHTRFALGTRSVDMGIAAVDAGNSIGLDITTYGRAGTVPVKGSKRAPSGAALCKSGQTTQWTCGKVGSYNVSVTYTDQNGGPDTVVTGLASSSVCTQGGDSGGAYVSGDQAQGMTSGGPSNQRCNGQVNSPGSSYFQPLDDALAYYGLTLNTK

SEQ ID NO: 44043 - protein, 296 aa, Streptomyces roseosporus NRRL 15998
MRLSRPHSLTRRARLIAGATGLAAAAALAVPATAASAQPAPKTFSATELNQTAASVRTADVGGTAWYVDAASGKVVVTADSTVSKAEIAKLRSEAGVNADALVVKRTPGTFSKLIAGGEAITTGGARCSLGFNVQDSAGTKFALTAGHCTNIGSSWSIGTTTGSSFPGDDYGIIRHSDPGAADGRVSLYNGSYQEIDGAADATVGQSVQRSGSTTGLHGGSVTGLNATVNYGADGIVSGLIQTNVCAEPGDSGGALFSGSTALGLTSGGSGNCSSGGTTFYQPVTEALGVYGVSII

SEQ ID NO: 44044 - protein, 779 aa, Streptomyces roseosporus NRRL 15998
MLAAPGAASAAPEDDPYAALRTTWSALILGEGFSPTAEPFKSRLADLGAKASQWLDTMAPVDGSLWPDAVFADPDPDTDPESYVFSGRMADSFIRLNTMAQAYRQQGTGLTGDTALRDAVLTGLEHLNTQVYNDGQTRYGNWYSWQIGAPQALLDVCVLMYDAIAPEARERYCAAVDHFVPDSAVASYTGTSTGANRVDLCRVLALRGVVGGTAAKIALARDALSPVFPLVTKGDGLYADGSFIQHTTVPYTGSYGSVMLGGLGLLFALLKGTTWEVTDPKRQVVFDAVENAWAPFLYNGLVMDSVAGRAISRGEVDDHRRGHPIMASIVLLGQGASAAENARWRALVKGWAQRDYYSPPLSNTSLGLTALARIKSVLDDTSLTPVAEPTGHRLFPDMARATHRRPGWAASLSMADRRITFYETGNGENLRGWHTGNGMLYWWGDTFANGQYSDAFWPTVDPYRLPGTTVSRKVLADGAGGDWGVALPDVNWVGGVTDSKRAAVGQYLKGLTSTLMAKKSWFLLDDTVVCLGAGIHGRDGAAVETTVDNRNLGPTGNAPFTVDGSAKPVAAPWSATLSGASWAHLAGHGGYVFPGGATVKALRENRTGRWRDINRAGSTDPVSRKYLTLWFDHGTDPSDATYAYQLLPGASEQRTAARAADSGWLRVLANTDDQQGVAVPSLGLTAVNFWFGGSVGPLVADAPCSVMVTEHADGTATVCVSDPMRARTSLTLTWNRAVASVVSKPATVTSATTGASLRLVFGDLSGTRGATQTVKVRLA

SEQ ID NO: 44045 - protein, 179 aa, Streptomyces roseosporus NRRL 15998
MALTLASATAAHAAPAPDPAAPSTAAVVTLRYDDSRAGGWEAAIAAGVASWNGHVGNVKLVEAAPGTRAEILIVATSGWPQATLGPVRPGGQARVELGSQAVTEGHDKTRIAAHELGHSLGLPDTKPGPCSQLMSGSSAGTSCTNAVPDAAERARVESAYAGGLASRVPADGRILVDAP

SEQ ID NO: 44046 - protein, 218 aa, Streptomyces roseosporus NRRL 15998
MRHLRNAVATAAAGLGLVAALGTAPVAVAAPAPAAPSASSTIAAYNGSGENAAANQAFLDAVMKSVAEKRAANPGIKAVTVTYNASSAPSFRTQIANSTRIWNSSVSNVQLQEGSNADFTYREGNDPRGSYASTDGHGRGYIFLDYAQNQQYDSTRVTTHETGHVLGLPDNYSGPCSELMSGGGPGPSCTNAQPDANERARVNQLWQNGLASLARSAS

SEQ ID NO: 44047 - protein, 392 aa, Streptomyces roseosporus NRRL 15998
MCVSRPRNSGRPILRVRAPHMLRARPHRRSNLKHRRISRKRATLAGSAVVALVAAGFTFQSANASDDVPEFAAKTLSAGAAGKLADTLNRDLGADAAGSYYDTTAKTLVVNVVDEAGAERVRQAGAKARIVQNSLTELKSARQTLTDKATIPGTSWAVDPVTNKVKVTADSTVDGAAWKKLSAVVDGLGGKAELVKTKGEFKPLIAGGDAIFGSGSRCSLGFNVVKDGEPYFLTAGHCTESVTSWSDSQGGAEIGANEGSSFPENDYGLVKYTSDIEHPSEVNLYDGSTQAITQAGDATVGQAVTRSGSTTQVHDGEVTGLDATVNYGNGDIVNGLIETTVCAEPGDSGGALFAGDTALGLTSGGSGDCSSGGTTFFQPVPEALAAYGAEIG

SEQ ID NO: 44048 - protein, 299 aa, Streptomyces roseosporus NRRL 15998
MRIKRTNNRSNAARRVRTTAVLAGLAAVAAMAIPTANAETPRTFSANQLTAASDAVLGADIAGTAWNIDPQTKRLVVTVDSTVTQAEINTILKSAGANADALRIERTPGKFTKLISGGDAIYSATGRCSLGFNVRSGSTYYFLTAGHCTNGTGTWYANSARTTVLGTTSGSSFPNNDYGIVRYTNSTIPKDGTVGGQDITSAANATVGMAVTRRGSTTGTRSGSVTGLNATVNYGGGDVVYGMIRTNVCAEPGDSGGPLYSGTRAIGLTSGGSGNCSSGGTTFFQPVVEALNAYGVSVY

SEQ ID NO: 44049 - protein, 286 aa, Streptomyces roseosporus NRRL 15998
MDNATPHEPNASDEASGDRRRISRKGLLKAALVASAAPLLAGGGVALARDAAATGDGPLALTPECDDGDDTTPPQMEGPYFKPNSPRRTSLVTTGTPGVPLTVSGYVFGRACRPISGALLDFWQADTNGAYDMVRFDFRGHQFTGADGSFSLTTIVPGLYPGRTRHIHVKAQAPGGRILTTQLYFPNEPRNNTDALFDPRLLMNVRNVGNGRQGTFDFVLDVAQTPGPTDPPTDPPTEPGTSWAAGTSYRAGDRVTYGGVAYRCLQAHQAVSGWEPPNVPALWERG

SEQ ID NO: 44050 - protein, 455 aa, Streptomyces roseosporus NRRL 15998
MERTTLRRRALVAGTATVAVGALALAGLTGVASAGPAGTTAPPVSADSLSPGLLAAMERDLGLDADDARSRIANEYRAAAVAAGLEKSLGASYAGARVSGVKAALTVATTDASQTARITEAGAKAEVVGHSLDRLEGVKEALDKVALRKAPKDVPVWYVDVEANRVVVNAASTAAGTAFLKAAGVDSALVTVARSAEKPRTFADLRGGDAYYMNGSGRCSIGFSVKRGTQNGFATAGHCGRVGTTTNGFNQQAQGTFQGSTFPGRDYAWVATNANWTPRPTVNGYGRGDVTVAGSTAAVVGASVCRSGSTTGWHCGTIQQLNTSVTYPEGTISGVTRTSVCAEPGDSGGSYISGNQAQGVTSGGSGNCSSGGTTYFQPLNPLLQAYGLTLVTSGTPTDPPTTPPTDPPGGTWAAGTAYAAGATVTYGGATYRCLQAHTAQPGWTPEAVPALWQRI

SEQ ID NO: 44051 - protein, 463 aa, Streptomyces roseosporus NRRL 15998
MRGAAVAAAALTAWTAAPSAAAPPDRDFGRHGHCARQDILRVPGADRQQADCLPELTTAGTVTSGHTDPADWAGLTPEGLATPSGVPGIQIDGHFPDTSTGNTNHGWNHDSQFVIRLPDRWNGGLVVAGSPGVREQYANDRAFGDWAVARGYAFAATDKGNTSAAFHRDGRAPGDAIAEWNTRFTQLTRAARLVVAQRYLRPPSRTLAMGMSNGGYLVRWQLENHPGLYDGGVDWEGALWRADGPNLLTFLPPALRAYPRYAAGGADAEEAHRTMTAAGYPAGSEFLWPYHHQYYWDLTQRIYREELDPGFDGAAEAGTPFCAPGTPACDADYAYAERPDEVRDAVAKIALTGRIGKPLISFHGTLDVLLPISRTSDTYARMVRKEGRSALHRYYRVEGGTHVDSLVDTFPDRLRPLVPCHRSAAAALERWLDDGRRPPSSRTLKLPAKATPAERLTRCPLDR

SEQ ID NO: 44052 - protein, 439 aa, Streptomyces roseosporus NRRL 15998
MSYVIPSHPAPNGAPPGAPPPGSRRGGRWNRTVRRLAAVVALATGAALAGPGTAGASAAGPTEARAAAALERVTSFGANPGALNMYVYRPSALPANAPVVVALHGCTQSAQVYSDNSGLNTFADRHGFLVVYAETTTVNNANKCFNWFQPGDTRRGQGEAASIRQMVAHAATAHGVDTGRVQVTGLSAGGAMTSVMLAVYPDVFAAGAVVAGIPYGCGTDVVSAFGCMSPGVDRTPAVWAQAVRDAHPGFAGPWPRVAIWHGDNDATVAPRNADELRDQWTAVHGLGQTPDRTSTIGPNSTRRSEFLAADGDASVVEVNRVPGIGHGTPVDPGSGAEQCGATGTQHFIDSVCSSYWITRFFGLDGTTTPEPPVDPPTEPAACWTANNYEHVRAGRATTTGGQVYAKGSGQHLGLYNTFVTHTLKESPAGHYVVADGSCP

SEQ ID NO: 44053 - protein, 399 aa, Streptomyces roseosporus NRRL 15998
MRNTRKFSLAAAGVLLSAATVLGTQTMAQAQDGATTPRYQPEMVEALAASLGVSEKAAVDRLDRQEAQQAKLTGLQKRGISGDGAFFDASGRLTVNADDQAEAARIEKAGLDARVPARGQAALDRIKAELDRLAAAKTPSGVVAWSVDLPSDQVTVKVNNERGAAAKAFLAKAAEHGSAVRIVRGEEKLEAKAAIYPGSKMTFNNTTRWCSVGYGARDSSGKQYLVTAGHCVTNTLRYDGAAFAQGYKTRYALGTRSVDMGILTINSGHSITTGVGTWGNSNPVAVRGGTRASSGAAVCKSGATTGWTCGTIGSYNNTVTYVDLNGGPDTVVSGLATSSVCVEGGDSGGAYISGNQAQGMTSGGPTNQRCTGGVNSRGSSYFQPLDDTLRYYGLTLNTN

SEQ ID NO: 44054 - protein, 355 aa, Streptomyces roseosporus NRRL 15998
MRRNSRARLGVSLLLVAGALGLGAAPSTAADAPAAAPSAIPAPSAYALDAKVDRALGAATAGTYLDAKTGKLVVTVTTDRAEEQARATGATVRRVARSAAQLDAAMETLEAEAKITGTSWGIDPRTNKVAVEADSSVSARDMARLEAVAERLGGAVDIQRVPGEFRREVLGGGAIYGGGSRCSAAFNVTKGGARYFVTAGHCTNISANWSASSGGSVIGVREGTSFPTNDYGIVRYTDGSSPAGTVDLYNGSTRDITSAANAVVGQAIQKSGSTTKLTSGTVTAVNVTVNYGDGPVYNMVRTTACSAGGDSGGAHFAGSVALGIHSGSSGCSGTAGSAIHQPVTEALSAYGVTVY

SEQ ID NO: 44055 - protein, 259 aa, Streptomyces roseosporus NRRL 15998
MPGPPTSGTRRAGRPWKDPAPRRKDPPMSSRGSTLAALGAASALFMVTACAAATSTDTASSPGSAVPAAATTTDPDVGAPPGAEILGRAAVGEPFKLTIDSSDEARPDEFEITVEDVTCGEPLDPEVLAHDSLSAPTEPPTPEDGKQFCVVRMEVLNVGKSEARWTADDTVTLNVDDTAYSQTRDDVQLTTAYEEYWYDQGKPRPSFGLNPASKGPVNAVFQIPTADEPTTLWFAAARWLELTGPEPGYLVRIQPTTQS

SEQ ID NO: 44056 - protein, 753 aa, Streptomyces roseosporus NRRL 15998
MGVALLAQPAQAQPNSPSAATASNASQPSRPAGTADPAPQAQQSPAADTGHRTEGRRSASELPPLSADKSPLREAYGDHDAPKERGAGKKPSAKAAAACDPADFTGRTGAELVRQIKASTTDCVNTLFSLTGSNAQLAFREAQMVSVAYALRDNAAYYPGDGSTGTPQLVLYLRAGYYVQWYNPDVVGPYGSALRTAIRSGLDSFFASPRSRDVSDENGETLSEAVILIDSAQENARYLNVVKRLLADYESSWNDFSRMLAAVNGVYTVTFRGHQVPEFVSAVEADPSVIDSLHRFAADHLSLLGGDHAYLTSNAGRELGRFLQYPSLRGKARPLATDLLGRSSITGPTAALWVGIAEMADYYDKANCSAYGVCDLQERLKREVLPVRHTCSPGIRILAQQMTSAELSASCTSLIEQDAYFHRIAKDDGPVADDHNTSIEVIAYDSSADYQTYAGAMYGIDTNNGGMYLEGDPSVVGNQPRFIAYEAEWLRPDFHIWNLNHEYTHYLDGRFTMYGDFTENMSTPTVWWVEGFAEYISYHYRGEPYTAAMTEAGKGTYALSTLFGTDYSHDTTRVYRWGYLAVRYMLEQHPADMDTVLGHYRTGQWAAARTHLTSTIGTRYDSDFRTWLAGCAAGDCGDGSTTPVSECTDPDTRVLGENCRRSNLSATTGNYAYHYLYIPAGTEELKITVSGGTGDADLYYSGTGWATTASHTSRDTGPGNAHTLTVTNPPAGANYISLHAASTFGGATVTTAY

SEQ ID NO: 44057 - protein, 281 aa, Streptomyces roseosporus NRRL 15998
MPAALAALVTVAPAASASAPAAQPCAPLHSATADYRAGDTVSHHGRNWSAKWWTRGENPGAGSAWADRGACTGGVSDFVIGEEEFDAIFPDRDPFYTYQGLIDALHAYPRFANVGTPQTRAREAAAFLTHADFESVGLKYVKEINEANYWRKCDDTQPFGCPAGREAYYGRGPIMFSWNFNYKAAGDALGLDLLNDPWLVERDPSVAWATALWYWNTQNGPGTMTSHDAMVGGAGFGETIRSLNGALECDGGNPASVAARVERYERITGIVGVAPGAGLTC

SEQ ID NO: 44058 - protein, 291 aa, Streptomyces roseosporus NRRL 15998
MALLVALGAVVAALVVLPAATAQAATCATAWNSSAVYTGGGTVSYNGRNYTAKWWTQNETPGSSDVWADNGACGTGGGGEDPGQSNGFVVSEAQFNQMFPNRNPFYTYQGLTDALSAYPAFANTGSDEIKKREAAAFLANVSHETGGLVYIKEVNEANYPHYCDASQPYGCPAGQSAYYGKGPIQLSWNFNYKAAGDALGIDLLNNPYLVEQNAAIAWKTGLWYWNTQSGPGTMTGHNAIVNNAGFGETIRSINGAIECNGGNPAQVQSRINKFTQFTQLLGTTTGSNLSC

SEQ ID NO: 44059 - protein, 260 aa, Streptomyces scabies
  strain 87.22 Streptomyces scabiei
MTSAARPRVRTRALTGTLAAFSLSFGMIMTNGATPASAATWPSANGSQPVSSTISVSGTRDGGMVRYYGSGELAGDGQDEGQDPIFKLAAGATLKNVIIGAPGADGIHCEGNCTLQNVWWEDVGEDAATFRGGSTYTVTGGGARKAADKVFQHNGPGTLNISNFAVSEFKTLYRSCGDCSTQYTRKVNLNNIEVTGTGSTARLVGINVNRGDVATLRRITILNDSGRKVVPCQKYNNNTAVGTGPDSTNCLYSSSDITYR

SEQ ID NO: 44060 - protein, 443 aa, Streptomyces scabies
  strain 87.22 Streptomyces scabiei
MTPTPHHRARGPLRSALRMLLAALVPLLAATLLTAPAAAASDTGAEAAPRAALTEITGFGTNPSNLQMYLYVPQRVTAKPAIVVAVHYCTGSGPAMYNGTEYASLADRYGFIVVYPSVTRSSKCFDVASPQALTRGGGSDPVGIKSMVDWTVRTYGADTGRIFATGISSGAMMTNVLLGDYPDVFAAGAAFAGVPFACFATTNGSEWNSDCANGTVIRTPQAWGNLVRGAHPGYTGPRPRMQLWHGTTDDVLRYPNFGEEIKQWTNVHGVGQTPAATDSPQSGWTRTRYGSTGDRAPVEAISLQGTGHNVYARGMGERVLTFFGLTGSGPGPTPEPPAGPCKVTVTTQPWSTGLTASVTLTNTGTTAVDGWKLGFTLPAGQTVTSGWGATYSPATGAVTATNAAYNAAIAPGASVSIGYQANHTGNSAAPSAFTLNEAACTGG

SEQ ID NO: 44061 - protein, 996 aa, Streptomyces scabies
  strain 87.22 Streptomyces scabiei
MAKASSQRTRATILTATAGLALAVALLPGSANAVPDDPTGRPAPGNGSPAAESEPPAPSQQTLVRRDARLAKAEQRPGVQRLRDRLGAQGVLELDPATGTARQVARLDGYLTARSAADPEDVVRAYLRAHPDVFGLSAGQVRALTLRKQYTDVAGTRHLSFVQSVDGVPVFGNGVKAHVARDGRLISVQGSPVRNLPPALSPGRITGTEARRTAVRDIAGARAVGDDSTRGDTAKQVVYAASGGAARRAWRTVTSPDGHAMWLHVVDAENGRVLYRQNLSSDQSADRQSGRTAGVTTAGKAAEKVTRKATQNVTENAGENAGEKATTPPAKALAWDHAPGDVRGGKQRSRNLTAPGWLPAGAKTLDGTVAHVYSDVNDNNQPDAGEEVAPTKKGAFSFPFKPFTGDGCGTPVPCSWDAKTPNSWETNRAQNAAQVFYFLGTFHDHLKAAPIGFTRAAGNFDGRDGDAVQAQTDDGAAVKDGLPDDDHLNNANMGTPPDGRPPTMQLYLTAPSDGYPVVQGNWGDDAATVYHEYTHGLSNRLVVDADGVSTLVSQQAGAMGEAWSDWYALDFLADEHLRRDTRRTDGEMTLDPAGWTDSAPSRTQGLDCPVGSASPRCPGTSAAGPGGYTYGDYGKISRRGPESHADGEIWGETLWDLRSALGSPLSQSLVTRAMELSPANPSFLDQRNAILQADTVVNGGRAHDRIWKVFAHRGMGYFAAALSGDDTRPDEDFSLPPGADTPVVTLTGKVTDDASGAAVGGVTVSVSGHSSGFPGADFSAVSAADGTYTIPDVPEGTYRKVYASGNGYEPQIRTVVVGRAGGADWQVRRDWAASSGGAEVADFSGPDNSGFGCGPGGLIDMAGTVWGSDIGDGGADPHNTVRLPAAVDISELLIDPTAGCGDDATASLGDYRIDTSADGTTWATAAEGHFGPADTGRENAVALRADTGENVRYVRLTLLGNQAADNGVDCAKDSGPSGCRYLDVTELVVHGAPHRG

SEQ ID NO: 44062 - protein, 187 aa, Streptomyces scabies
  strain 87.22 Streptomyces scabiei
MHVRTLTGALTAALVVSLSLTGGQAVAASADPAEVPVAARVFTYDAGGSAEFRSAVDRGAAIWNESVDSVELRPVATGQRANIRVLADNGWPRALPTTLGNGTVYIGRQAVDQGYNTIRISAHELGHILGLPDRKPGPCSSLMSGSTAGIACTNPYPNAAEKSEVEGNFGGLLVGRTPAARTGVIVD

SEQ ID NO: 44063 - protein, 486 aa, Streptomyces scabies
  strain 87.22 Streptomyces scabiei
MSNVQSSSYETYESHGPDGTSRPSVAHDAGTLPYGTGAPPYGTEAETLPYGAGTPPYEAETLPYGVYADTVHADTYRPAYAARTVPDRRPAEPDGPFSGAGAAGEGGEGGSRRAVRRRRAADRPGSLRRLVPQALVVAFLAGGTSAFVAKDKAIELTVDGRPRTLHTFADDVSELLADEGVAFGAHDVVAPAPGTALSSGDEVAVHYGRPVALTLDGRRRQVWTTARTVDGALQQLGVRAEGAYVSTSRSQRIGRQGLELDVRTERTVTIMTDGRTRTIRTNAATVGEAVEQAGITLRGEDTTSVDASSFPRDGQTVTVLRVTGSTEVREVLVPFRVHRVEDPSLFRGTEVVERAGRPGTRRITYALRTVNGVRQRPRLLRTEVVREPRDQVVKVGTKAMPTSVAGAEGLNWAGLAACESGGRANAVDASGTYGGLYQFDTRTWQSLGGSGRPQDASAGEQTLRAKKLYVQRGASPWPHCGARLRG

SEQ ID NO: 44064 - protein, 351 aa, Streptomyces scabies
  strain 87.22 Streptomyces scabiei
MLSGNGRHRRPRQAPALLVAAGVTGSAIAIPLLGATGASAASGTTWDQVAECESGGFWSADTGNGRYGGLQLTQANWEKYGGLEYAKTADLASRSQQIAVAEKVLADQGVGVWSTCGLLHNLGGDSGSADVDTGVVDDASNSGGGSGTSGSSDSSASPDSAGSADSAKSTDDADSGDGSGKRAASPDASADTADGSAKATTDTDSADSTGSGDGDGDSRESDGGTSDDARRSDGSAASEDGESGTGRHRGASAEEGSGTDTGSATESGDGSRADGASSGRHASRDGGASREAVEGAYTVRVGDSLTGIVNSLGLDGGWRSLYSENERTVGTDPDLILPGQTLEVGAETGKK

SEQ ID NO: 44065 - protein, 233 aa, Streptomyces scabies
  strain 87.22 Streptomyces scabiei
MLFSSKGKHRRPSKAARAIAVVGVTGAAAVAAPLMAAGSASAATASEWDAVAQCESGGNWSINTGNGYYGGLQFSASTWAAYGGTQYASTANQASKAQQIAIAEKVLAGQGKGAWPVCGTGLSGASYDGAPASSGTTNSSGSSQSTQESTGKSTKSTEDNRASRSSERATVKTPTGKKVKKGDGEYKVVKGDTLSGIAAKKNVKGGWEKLFELNKDIIDDADFIYPGQQLHLS

SEQ ID NO: 44066 - protein, 426 aa, Streptomyces scabies
  strain 87.22 Streptomyces scabiei
MPSIDVVVAREILDSRGNPTVEVEVGLDDGSTGRAAVPSGASTGAFEAIELRDGDPNRYLGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLILEAIKEAGYTPGEQIALALDVAASEFYKDGVYTFEGKERSAAEMTEYYADLVASYPLVSIEDPLFEDDWAGWNTITEKLGDKVQIVGDDLFVTNPERLARGIEEGSANALLVKVNQIGSLTETLDAVEMAQRNGFKCMMSHRSGETEDVTIADLAVAVNCGQIKTGAPARSDRVAKYNQLLRIEEILDDAAVYAGRSAFPRFKG

SEQ ID NO: 44067 - protein, 451 aa, Streptomyces scabies
  strain 87.22 Streptomyces scabiei
MKRVARLTAAGGLICGTLMVAQAAMATEPTTSPPTTRSAVLAASGTGNGLVGELGSERTAGTWIADDGKPVVAVTDEEAAAEVERAGARPKMVEFSGEDLESAAKALRSAPRVSGTSWAIDPASNEVVVRADSTVSKKDWSSLTDLAEKIGASVRMERTEGTYTMRLNGAQPIFGTGGRCSIGFNVTDGERDFMLTAGHCGPAGSVWFSDNEGRQEIGRTTESEFPGSDYSLVQYLQDAPSNRTNVVSVGDGRGVRITSVGEAAVGQRVFRSGSTSGFRNGEVTGLDATVNYPEGTVSGLIETTVCAEPGDSGGPLFSEGVALGVTSGGNGDCKEGGTTFFQPLSDALDDLGVRLTGLPQSAAQPTAAADGSSGDDSQGAAAPGGAEPGSVEPVDSVSAASDLLDRLADPRNVGPGLLVVAGSMVALAATRFIRTEQDRQAYRRQYSGSWG

SEQ ID NO: 44068 - protein, 458 aa, Streptomyces scabies
  strain 87.22 Streptomyces scabiei
MAALGAAALILPNAMASQTDAKGAAPRTLAASDASDLASKLREALGDAFAGAYYDSAEKQLVINVIDGLQIDGDDNNVIIQAQSAGAKVREVDNSWSELQKGAATLKAKAAVPGTAWAIDPRTNKIQVTADSTVTGENWDTIESATKSLGTGMATIKKSAGTFKPFLEGGDAIFGGGARCSAGFNVVNAEGAPAFLTAGHCGVAEAEWSEEEGGAPIATVDAATATFPGAGDFALVNYNDPATQAASTVDLGNGQTVDIKAAGEAEVGLQVFRMGSTTGLADGQVTGLEATVNYPEGTVTGLIQTDVCAEPGDSGGSLFTQDGQAIGLTSGGSGDCTVGGETFFQPVTTALAAVGATLGDAGAGAGEQADGGAAAGAGEQADGGAAAGAGQEEGAAAAGAGEEEGAAAAGAGEEQGAAAGAGDDAGAGQQHDQGAGDQGGEQQQGAEQQGAEQQGVQR

SEQ ID NO: 44069 - protein, 147 aa, Streptomyces scabies
  strain 87.22 Streptomyces scabiei
MHTMRKTARWAATLTLTVTAVCGPLTGTALAAPEPAAAGLYAPSALVLTTGHGEAAATVTPERAVTLTCAPKAAGTHPAPVDACAELRRSGGDFEALAGNTGAMCNKRYDPVVVTVDGVWQGKRVAYERVFANSCLKDAAASVLYAF

SEQ ID NO: 44070 - protein, 220 aa, Streptomyces scabies
  strain 87.22 Streptomyces scabiei
MSERVGCADTTRAGFRGSRTTAVLAGAALLAPLGLLTLTGTASAADSGVWDRIARCESGGDWHINTGNGYYGGLQFAASTWRAYGGTAYAPTADRASRSQQIEIATKVQRAQGWGAWPTCSRRAGATGSAPGAPSAGAATTGSGRATPARPQKSAGTPPSRPVGHADRGSSRGDYTVRQGDTLNGIAARHGTTWRQVYAANRAVIGGDPDLIVPGQRLDL

SEQ ID NO: 44071 - protein, 330 aa, Streptomyces scabies
  strain 87.22 Streptomyces scabiei
MSGIRTVALICASRAPTPRGPPTSLWRERTVRIKRTIPRSGITRRTRLIAVATGLVAAAAVTVPTASAAGTQTFSASELKSAGSSVLKADIPGTAWAIDPATDKVVVTIDSTVSQGELAKIKEAAGENAGALTIKRTPGKFNKLIKGGDAIYASSWRCSLGFNVRSGSTYYFVTAGHCTDGAGTWYSNSGRTTVLGSTAGSSFPTNDYGLVRYSNTSIVKDGTAGSVDITSAATPSVGTNVIRTGSTTGTRTGRVTALNATVNYGGGDIVYGMIQTTVCAEPGDSGGPLYGSNGVAYGLTSGGSGNCTSGGTTFFQPVTEALSAYGVSVY

SEQ ID NO: 44072 - protein, 359 aa, Streptomyces scabies
  strain 87.22 Streptomyces scabiei
MKHRRISRRRAVVTGAGIAALVAAGVTFQTANASETTPTAEPKALSVLAAGKLARTLGTDLGADAAGTYYDAKSKLLVVNVLDEAAAETVEAAGAKARVVENSLAELKSARTTLKADATIPGTAWATDPTTNKVVVTADRTVSKAELARLTEVVDGLGAKAELKRTEGEYKPFVAGGDAITGGTGRCSLGFNVVKGGEPFFLTAGHCTEGISTWSAGGRVIGENADSSFPGDDYGLVKYTADVAHPSEVNLYDGSAQAISGAAEATVGMKVTRSGSTTQVHSGTVTGLDATVNYGNGDIVNGLVQTDVCAEPGDSGGSLFSGDKAVGLTSGGSGDCTSGGETFFQPVTEALSATGTQIG

SEQ ID NO: 44073 - protein, 295 aa, Streptomyces scabies
  strain 87.22 Streptomyces scabiei
MSRRRISAVLTALVIGGATPLLLPAQSASAAPCSSYANWVAGKSYVTGNIVRYTDGKAYIAEHDNPGYDPTISTWYWEPYACENGPGNPSGFVVSEAQFNQMFPNRNSFYSYSGLRAAMSAFPAFATTGSDTVKKQEAAAFLANVNHETGGLVHIVEQNTANYPTYCDWSQSYGCPAGQAAYYGRGPIQLSWNFNYKAAGDALGLNLLGNPWLVQNDSAVAWKTALWYWNTQKGPGSMTGHNAMVTGAGFGHTIRSINGSLECDGKNPAQVQSRVSAYQRFVQILGTSAGGNLYC

SEQ ID NO: 44074 - protein, 371 aa, Streptomyces scabies
  strain 87.22 Streptomyces scabiei
MAASGRHRRYQPNRINRASLTVTAGGAGMALPLIGTGAAEAADVETWDKVAACESTNDWNINSGNGYYGGLQFSQSTWEAFGGTAYAARADLATKEQQIAIAEKVLDGQGPDAWPVCSGRAGLTIGDVKPQTTPQSQAGKVEMYTVVRGDTLSGIADAEDVRGGWRRLYENNRRTIGSDPDVIIPGQRLSLHAAGRKEESKKERKPEKRQESRQEKKPVHKEHKGGKQQTSEKRQQSASLVAPVGASLGTPYRASGSSWSKGYHTGVDFPVSTGSSVKSVAAGQVVSAGWGGSFGYEVVIRHADGRYTQYAHLSAISVKAGQGVSTGQRIGRSGSTGNSSGPHLHFEVRTGPGFGSDIDPIAYLRAGGVRI

SEQ ID NO: 44075 - protein, 791 aa, Streptomyces scabies
  strain 87.22 Streptomyces scabiei
MGMTPTRRTVLLLTAALAAAPPPAAHAADRTAPGDDAYDTLRRRWLGLALGEGYDPAAEPYATRLRETGDLAHAFRAAMEPSADSLWPGHRFDPPAGITQSYSRLWTMAQAYAQPGTGRTGDAGLLADILRGLDHLTATVYHPATTRYGNWWEWQIGSPRLLMDIVAALYDELTPARRAAACAAIDHFVPDALLRDYAGTSTGANRVDLCRSVALRGILGRAPEKIALARDALSPVFPYVTRGDGLYADGSFVQHTWVAYSGTYGQVMLDGLGRLFALLAGSAWEVTDPNRQIVLDSVERAYAPLIHDGLVMDSVNGRAVSRGYLKADDRHILRSDHFHGQGIIAALALLALGATAAERERWHGLIKGWIARDTVTPILTARQFGVADLARLHAVAASPVAAAPEPVGHRLFPAMDRAVHRRPGFVVNIAMASDRIAHYECGNGENPRGWHTGAGATLWWAPGRGDQYTDWFWPTVDWYRLPGTTVSTKRLADREGGEWGAPKPAVRWVGGTTDGEYAAIGQHLKGLGSTLEARKAWFCLADSVLCLGAGVTCADGVPVETVVDNRNLGASGGTVHPPLVRGRLWAHLEGHGGWVFSDFPAGTRGSLVPAPALRTLREDRTGAWSDINTGGTTERRTRRWQTLWLDHGTDPVNAGYAYLLMPGASRHAVEARAADRRWLSIPANDSACQAVHVPSLGLFGAVFWQPGTVGPLTASAGACVLVRRRGRAATLRVSEPPRTGEPMEIIWNGPFREVIRADASVEVLESARGRLRLRISPGTACATHTCDLTLP

SEQ ID NO: 44076 - protein, 345 aa, Streptomyces scabies
  Streptomyces scabiei
MSSAMRKTTNSPVVRRLTAAAVALGSCLALAGPAGSAGAAPADPVPTVFFGDSYTANFGIAPVTNQDSERGWCFQAKENYPAVATRSLADKGITLDVQADVSCGGALIHHFWEKQELPFGAGELPPQQDALKQDTQLTVGSLGGNTLGFNRILKQCSDELRKPSLLPGDPVDGDEPAAKCGEFFGTGDGKQWLDDQFERVGAELEELLDRIGYFAPDAKRVLVGYPRLVPEDTTKCLTAAPGQTQLPFADIPQDALPVLDQIQKRLNDAMKKAAADGGADFVDLYAGTGANTACDGADRGIGGLLEDSQLELLGTKIPWYAHPNDKGRDIQAKQVADKIEEILNR

SEQ ID NO: 44077 - protein, 269 aa, Streptomyces sclerotialus
MRTRSKAAVTGRTAAGAVLGIALLTAPAAAHAAPAGLDDPAKKEIAMQLVSSAENSSLDWKAQYGYIEDIGDGRGYTGGIIGFCSGTHDMLELVELYTQRKPGNVLAKYLPALREVDGSDSHEGLDPGFTKDWRTAAKDPAFRKAQNDERDRVYFDPAVKQGKADGVGVLGQFAYYDAIVMHGGGNDATSFGSIRKKALAKAEPPAQGGDEKTYLSAFLDARVWAMKQEEAHSDTSRVDTAQRVFLTKGNLNLDPPLDWKVYGDPYHIG

SEQ ID NO: 44078 - protein, 64 aa, Streptomyces sp.
MRSEMTLTSTNSAEALAAQDFANTVLSAAAPGFHADCETPAMATPATPTVAQFVIQGSTICLVC

SEQ ID NO: 44079 - protein, 57 aa, Streptomyces sp.
MGNNEEYFIDVNDLSIDVFDVVEQGGAVTALTADHGMPEVGASTNCFCYICCSCSSN

SEQ ID NO: 44080 - protein, 388 aa, Streptomyces sp.
MRLKGRTVAIGSALAASALALSLVPANASSELPSAETAKADALVEQLPAGMVDAMERDLGVPAAEVGNQLVAEHEAAVLEESLSEDLSGYAGSWIVEGTSEHVVATTDRAEAAEITAAGATATVVEHSLAELEAVKDILDEAATANPEDAAPVWYVDVTTNEVVVLASDVPAAEAFVAASGADASTVRVERSDESPQPFYDLVGGDAYYIGNGRCSIGFSVRQGSTPGFVTAGHCGSVGNATTGFNRVSQGTFRGSWFPGRDMAWVAVNSNWTPTSLVRNSGSGVRVTGSTQATVGSSICRSGSTTGWRCGTIQQHNTSVTYPQGTITGVTRTSACAQPGDSGGSFISGTQAQGVTSGGSGNCSIGGTTFHQPVNPILSQYGLTLVRS

SEQ ID NO: 44081 - protein, 382 aa, Streptomyces sp.
MRHTGRNAIGAAIAASALAFALVPSQAAANDTLTERAEAAVADLPAGVLDAMERDLGLSEQEAGLKLVAEHDAALLGETLSADLDAFAGSWLAEGTELVVATTSEAEAAEITEAGATAEVVDHTLAELDSVKDALDTAAESYDTTDAPVWYVDVTTNGVVLLTSDVTEAEGFVEAAGVNAAAVDIQTSDEQPQAFYDLVGGDAYYMGGGRCSVGFSVTQGSTPGFATAGHCGTVGTSTTGYNQAAQGTFEESSFPGDDMAWVSVNSDWNTTPTVNEGEVTVSGSTEAAVGASICRSGSTTGWHCGTIQQHNTSVTYPEGTITGVTRTSVCAEPGDSGGSYISGSQAQGVTSGGSGNCTSGGTTYHQPINPLLSAYGLDLVTG

SEQ ID NO: 44082 - protein, 107 aa, Streptomyces sp.
YAPSALVLTVGHGESAIAATPERAVTLTCAPKAAGTHPAAGAACAELRGVGGDFDALTARDGVMCTKQYDPVVVTVEGVWQGKRVSYERTFSNDCMKNAYGTGVFSF

SEQ ID NO: 44083 - protein, 229 aa, Streptomyces sp.
  strain C5
MRMPLSVLTAAGLSLATLGLGTAGPASATPTAEGAPVVAYDGSPSAGSPADAKAEAAANRAFFEAVLRSVAEKRAANPKSTAAVTVVYNASGAPSFATQIARGTQIWNSSVSNVRLQAGSSGVDFTYREGNDPRGSYASTDGHGRGYIFLDYRQNQTYDSTRVTAHETGHVLGLPDHYSGPCSELMSGGGPGPSCTNAYPNSAERSRVNQLWANGFAAAMDKALEKSAR

SEQ ID NO: 44084 - protein, 291 aa, Streptomyces sp.
  strain K15
MRLRRAAATVITTGALLAAGTLGATPATAVTKPTIAAVGGYAMNNGTGTTLYTKAADTRRSTGSTTKIMTAKVVLAQSNLNLDAKVTIQKAYSDYVVANKPSQAHLIVGDKVTVRQLLYGLMLPSGCDAAYALADKYGSGSQAAARVKSFIGKMNTAATNLGLHNTHFDSFDGIGNGANYSTPRHLTKIASSAMKNSTFRTVVKTKAYTAKTVTKTGSIRTMDTWKNTNGLLSSYSGAIGVKTGSGPEAKYCLVFAATRGGKTVIGTVLASTSIPARESDATKIMNYGFAL

SEQ ID NO: 44085 - protein, 407 aa, Streptomyces sp.
  strain K30
MDGFSRRRMLMTGGALGAVGALGAATRALARPLWTWSPSASVAGTGVGVDPEYVWDEEADPVLAAVIDRGEVPAVNALLKQWTRNDQALPGGLPGDLREFMEHARRMPSWADKAALDRGAQFSKTKGIYVGALYGLGSGLMSTAIPRESRAVYYSKGGADMKDRIAKTARLGYDIGDLDAYLPHGSMIVTAVKTRMVHAAVRHLLPQSPAWSQTSGGQKIPISQADIMVTWHSLATFVMRKMKQWGVRVNTADAEAYLHVWQVSAHMLGVSDEYIPATWDAANAQSKQVLDPILAHTPEGEALTEVLLGIVAELDAGLTRPLIGAFSRYTLGGEVGDMIGLAKQPVLERLIATAWPLLVAFREGLIPLPAVPAVLWTLEEALRKFVLLFLSEGRRIAIDIPDVNRPS

SEQ ID NO: 44086 - protein, 278 aa, Streptomyces sp.
  strain N174
MHSQHRTARIALAVVLTAIPASLATAGVGYASTQASTAVKAGAGLDDPHKKEIAMELVSSAENSSLDWKAQYKYIEDIGDGRGYTGGIIGFCSGTGDMLELVQHYTDLEPGNILAKYLPALKKVNGSASHSGLGTPFTKDWATAAKDTVFQQAQNDERDRVYFDPAVSQAKADGLRALGQFAYYDAIVMHGPGNDPTSFGGIRKTAMKKARTPAQGGDETTYLNAFLDARKAAMLTEAAHDDTSRVDTEQRVFLKAGNLDLNPPLKWKTYGDPYVINS

SEQ ID NO: 44087 - protein, 406 aa, Streptomyces sp.
  strain R61
MVSGTVGRGTALGAVLLALLAVPAQAGTAAAADLPAPDDTGLQAVLHTALSQGAPGAMVRVDDNGTIHQLSEGVADRATGRAITTTDRFRVGSVTKSFSAVVLLQLVDEGKLDLDASVNTYLPGLLPDDRITVRQVMSHRSGLYDYTNDMFAQTVPGFESVRNKVFSYQDLITLSLKHGVTNAPGAAYSYSNTNFVVAGMLIEKLTGHSVATEYQNRIFTPLNLTDTFYVHPDTVIPGTHANGYLTPDEAGGALVDSTEQTVSWAQSAGAVISSTQDLDTFFSALMSGQLMSAAQLAQMQQWTTVNSTQGYGLGLRRRDLSCGISVYGHTGTVQGYYTYAFASKDGKRSVTALANTSNNVNVLNTMARTLESAFCGKPTTAKLRSATSSATTVERHEDIAPGIARD

SEQ ID NO: 44088 - protein, 546 aa, Streptomyces sp. [sequence omitted]

SEQ ID NO: 44089 - protein, 807 aa, Streptomyces sp. AA4
MATAAPRRRSALSRPLVSGQAGSDRLGHSRPNTLGGTVMPVNRRTALRGGAVAAALAVTARPAFAAPAADPLKKIVAGYRELQTGINRPSPERSAALKNLGRVAKSYYDGMSVSGNGPLWTDLPLGPGSDYTTSMYARLRAIAVDWGTPGSTLSGDPKVLDSIKKALELIYASQYNPQVGEIGNWYTYEIGVPYYLLHTLVTVADQLTADELARYVSPIKRFVGNPNLRANNPKVVETGANRADKALISIVSGALIGDTAWIRTGIDAITDVAGGGAASVLARLDRAAGDGFHVDGSFIQHDTIPYPGHYGIVLLTALAGTIHVTEGTEYALPDDLKQKVYALVGDTFAPFVYAGALMEPVRGRMLSRQGETGHDIGHQLTVATLVLARSATGTVKTELSGLAAKWIKEGTYAPFLEIPDPERFAPGPDLVATPGIEFAQEMLAGRVRPAPIVAAHRIFGQQDRMVHVTEGWSASLGVGSARISRYESINGMNLHGWHVGDGVLYLFLPNAKGHYSDAYWPTVDPALLPGTTAKAGPPGPLAATPLTTKAHVGGVRWDARHGAYAMDFVSEDGSLTAKKSWFFTPAGIVCLGAGITDTSGQAVRTTIENRNLGENGRGTLLADARVVGDSSTLHRPRWLHLEHVGGYVLLDNAEVTALREDRTGAWRDVDTGANTKGTTTPNTRRYQKLVIEHGAKPVDAKYAYAVLPGASVVGTVASVLAWRVRANTPAVQALRLWDNTLLANFYSAGTVDEVSVSGPASVALGRGSLAVSDPTQLQDSVRVTVRRRTVEVPLKDTFGATKVVSLR

SEQ ID NO: 44090 - protein, 633 aa, Streptomyces sp. AA4
MPHRTLRPLAVACAALAAVVVAGLTILARPAPATATPAPSSGGLRIAYFDQWSIYQNAYYLKNVDKIADNIDYLLYDFENIDPANLTCFETTKATTPDPGGEDDPNAGDGAGDQFADYQKSFGSDISVDGTADTYNMPIVGNFHQLQELKARHPNLKVLLSLGGWTYSKYFSDAAASDASRKKFVSSCIDMFIKGNIPAAGGFGGPGTAANIFDGFDIDWEYPAHPGGHTGNHYSPNDTQNFTSLLAEFRGQLDALGKHYALSAALPGGQDKIAKIQTDKIHQYMDFADPMTYDMHGAWDKTGPTNFQDPLYPSPNDPSPNVPPGTEKYTIDQVMKAYTQGDPAYGIPGGFPASKLTLGIPFYYRGWTGVPAGSNHGLYQTATGPSAPHPLSGNVPGVAMYKELTGVVDNPATTFWDPTTQSAWFYDGTSFYGGSSKQSIKARTDYIHCNGLGGAMMFSLYDLDPDSTLFHAVVDGLAAPTEGCSGPPPTTPTTPTTPTTPTTPTTPTTPTTPTTPTTPTTPTTPPGGQCTAPAWDSGKVYNGGAVVSYNNHTWTAKWWTQGEQPGTSDVWSDNGACSGGGGPTTACPAAWSTSQSYNAGAVVSYNGHRWSAKWWTRGETPGSAAVWADNGTC

SEQ ID NO: 44091 - protein, 428 aa, Streptomyces sp. AA4
MALIEQVGAREILDSRGNPTVEVEVALDDGTLARAAVPSGASTGEHEAVELRDGDTGRYNGKGVERAVAAVLDEIGPDLVGVDAVDQRIVDQKLVDLDGTPAKSRLGANAILGVSLAVAKAAAESAELELFRYLGGPNAHVLPVPMLNILNGGAHADTDVDIQEFMIAPIGAESFREALRWGTEVYHALKSVLKGRGLATGLGDEGGFAPSLANNREALDLILAAIEKAGYVPGRDVALALDVAATEFFSDGAYTFEGSKRSAEQMSAYYGELLRDYPLVSIEDPLSEDDWDGWVQLTSEIGDKVQLVGDDLFVTNPDRLEEGITRRAANALLVKVNQIGTLSETLDAVSLATSYGYKSMMSHRSGETEDTFIADLAVATGVGQIKTGAPARGERIAKYNQLLRIEETLADAARYAGDLAFPRFSAEA

SEQ ID NO: 44092 - protein, 2761 aa, Streptomyces sp. AA4
MSDAGRATGVFLDFPDMKSFRAFSGVLRGSLVTTVLAALVASLTPAVAAGSPAASPVRQAAAAESSGGGLATSGARMAGPASGGVGVRQAAPPQVPEDVEVTLPGTSSRMRGVRIPVPGVEKSGIVVVKDLYGPAIEDAKTPKVVKFEDAPGGAAEAERFVKRMQDAVAEIAKSPDGARLLRGISEMRPLDQVGMDLATGQKDVTVVLHRSAWGERDAKYSNTAFTMAYDDTRAANGVGSPAEIVVPNESYAIFGVNLENSRRYMIREQDALAHEFIHASHYLEGSRYPHSADGSPVPITYTYTTYLGEKKHREVDIPLEEIRTLGGPDALLAAEQQKVHGLQRLVDKAIANSRLVMDTYIKLAPDRATKKLLKKIRDARNAAPDVTETSIAQQLGITPRRHYANISGTADAVTAAANEISQDKGIHWKIVEGEVKIVRAGTTITVEDTRDPAAVEQRLGGQPQALPLCPSSGARAACIPKQEPKDVPEATRSRVNENLQFVKSNPDAVLYRGEPIGHPGLREQGSVAKPDSVYLGVEDERGPAKVFSAGISAPGTEYSTLTDQWLQNSHLDVLKDSGWVTTTESADRAKAEAVPLSRAQFQPGTYRSPPRLVAWGWVYEIEPTEFFVSAQASAARIKNGYPDLPADKKAVYKDFETATPLSAATQATREWSAIRRISPENIIGAKHYRATYQATSDGRVADPNPKVEELPAGDAAANRAYKPAAAGYDPYADRGSGWSDTATVFKPLDRDPWRGAVEAQKILRGIPVTAQTGGTRTGVQPDAVNRRASDIVRDLLQDKQFMAEIPRPVQKPGSKELVWSKENAKAALDKVQGRLKNQFNLTEGPLNKAFLALWAYDMYELAKTHENVDGLEIAARVTALVPGLGDALGLADGINRGDAEAIAVNSVAMAAFMGALVVPALGQLLGGAVLTYTLGKLASEAVRYVVNAVAQWFTPPPEFSPDALRPGEIPTMPAVDVQNDVVPCSTERVITWKPDPRLKKDVDLVIRVTAADGGTYEMGADPQAGRRVFLDSSQTLTADLFYRAKRPWGTFVSHQITRQDITYRIGAAGPFPSPRNRCIADADRRVSWPVQDVGWIAARFPALFETRIPGRVSAAFAYPNSWDQRDGRYTAFGFFKGDTFVSYDDREDRLRDNTPKKIGDAWPGLGGSAYASGVDAAVDVRDDYGGAVLLLFKGNKMGRYKYAGSSSRLEWDDTIANRLHGLPPEFADGVDAVLPDSPRSGGLPGTDRIVLLKGDRYALYDLREQRRIPTGSDLIAARWRVPAGVDLRRGVDSALAISPDQAMLFAGQRAILARDSGEAASVPTGLPVSVQSAFEGRPDRFWSYEDGPGGSPRGRIRTAAVTDASSPDEKKKATFALMPSDIPRCYRLRTSAYPDPPPGGFADWEQRAASADDIKYSEAGRYVCPSRAPGGGFVLHPADLKKKTADNGRVLYAQAGLGQTGPYFANPADLSLVDQREFAARTTWHILAPHWSSEVDLPTENTASLVDVATRQAVLKQRDETNLELAADNGDLAWEPGWRSKFRLYTADADQSCYTFHDPWSRKDLYWDSETNKVSLRDPRTANDRGFAFCTAAAGDDGKGGKAFSLRPLGFDDRVLGWDPAAGAFRMTARAGVQSLRLSLGTPHRGTILPLMDAVDTTQPSSVHRPPAVSFDPVLGLSPLAPGKTGEAKVVFRNTQWYTFDVSGTGAAVTLLAPAHTRFVPQNQLQWEVSADGGKSWNKLGIASADCKALDEGQRLECPKSSAGSIAPGALIRLSPVVSVAADAPADRIPLPGRALIAMRLSLAQRVGTATAGIHVYIQDPNRSVRVRRSVVAASAGEQARLPFVLENAGHHVEADFGPVTFTAPEHSRFENQAEVSGHTVGNGIPDTPFTVSECAVRSLEAGKHDNRILACAHNSLGRTTWRGALGDADGKDKADERIVLGPLLLRVDQDAAQVVLTGGTVAMTLATAVVKRPELDGGAVPLGTYPAGGAALASIVVVGSVGFAGAARVPWSDEGMRPYAMLAPGHEGPVPWMMRNTGYELKSDMTGTVTFRAPAHARFVAPKDGKIPMEYSFGTSPASWRNMEPSGGRDPANTLHDCVATVDGKTMTCQNTGRKQMRWQGGQGAEGGKDKNAAVVRFRPTIRVDDDAPVDARAPGECGSASGDGTLELANATQYTDGGKWVPRGDTGRLSVRSDLALCIVDKTDRMSQPDSPPAKVFPGGETTVTWEIANNGYQLNADYTGDVVFTAPDNMVFLAPPDQKIPLQYSEDGGRTWRTDPRNPALFGCYFANTAKIMTCRNIGDNKAYPYNDNAWAGLWGNDLGGKKFALRFRFQVQARMNDDAPVGTCMNGGTATMNLANARRANGQGGEDKAARWNQLGSIALTGKLAVCTESGFPDAKDRSDTGKPALSGRLSPDGTGPVPWLVSNAGPNVSMDYTGTMVFHAPDHTTFVPQPRDYIRLQYSYDDGRSWVDADGNAGLYRCRTSSDKKTMTCNNTGWKGQQWYGSSGDGNGKRKFQMLRFLPILHADADSPVGNCSSGRQPSWLTLDNVEQDNPQGGKNKYGTQYAFGTLRTCFVNGFEGSKDRAPITSELAQWGTAEWQVSNSGYEVVGDFAGKVVFHFGVPGYAGFVKPQEGKLPLRYSLDDGKTWKSDRALTGCAISNDKLTMTCDNTQNSGTRWYGALGNAAGPDAEKDKREGIYQILLPIWVSPTLRGRCLPDGTGVLSIKNAVQWDGLAARPIPRGEMKVTGKLKVCVAKPEK

SEQ ID NO: 44093 - protein, 337 aa, Streptomyces sp. AA4
MALRKSLSILATMSAAALATGMCTHAATAQVQSLAQLQHAAVQQASQLTNTLGASSGGYWLDHGKAVVNVLDDASARKVEAAGLTAKKVKHSFAQLTQAKNQLDTVKNVPQTAWGIDTRANQVVVKIYSAAKPEVAKKVAEAAARLGDSARIEHRTGKLELYIADGDAISNGSSRCSLGFNVTRGGEPFLLTAGHCTNLGGTWSGDDVSGAEIVESDCPGADSGLLTRPNGTGPGEINTGQAITAAADPTVGEQMEKQGSTTGGGSGEVTSVDESVNFDVGVLNHEFGTTAQTDHGDSGGPAYDGSTGLGTLSGGDTQTSYFYPLTLELQSYGLNLA

SEQ ID NO: 44094 - protein, 462 aa, Streptomyces sp. AA4
MAVLDRELEDTAYGQLDFSDELRVTEQDVLAALGPDADLLMSEIDVDVDELIRLINAETTMLPPLVLPDEFEQDRTASPQAKKAAVEEGLREATKTWKRRFLKGAVLSLLVTVGGGGAAALAMNKSITVDVDGHQQTVHSFGGTVGDVLKDAGLSVGEHDALSPSPQAAVGDGGVIKLERGRQLNLVVDGVSRPSWVRATTLGEAMNQLGMGSMLSQGAWTSMPSSGELPLEGSTVQVKTLKHITLFDGTNAPRQVDTNAVTTKELVSDLKLNLGPDDAIEGGLDVSLKNGAEVHVSRMGVSMVNQEETIDPDVQKVDDPTQLQGQQSVEDPGTPGKKLVTYKVTKKNGEEIAREQVSEKVLVEAKSKIIKVGTKKPPAPAIGDTGAWDRIAQCESGGNWSINTGNGYYGGLQFDRQTWNAYGGQQYAPTADKATREQQIAIAEKVRDARGGYSAWGCGYKA

SEQ ID NO: 44095 - protein, 373 aa, Streptomyces sp. AA4
MRRRITLSLTGAAVLAASLAAVVPPAAQASPGLVAAMQRDLGLSAGQARTRLGQELTASRQLPAAQQAAGAAFGGAWFDPALGKLVVGVTDPAVADAVHRTGAETVPAQVTAAALDAAKTSLDRAAKAKQTPAEVSGWHADPRTGSVVVTLQPGAHGPDVDDFLARAREAGPVTVSTGARPRTLSAGTVGGDPYYINGNTRCSIGFSVHGGFVSAGHCGSKGSSVVGWDNSAMGTFAGSSFPGNDYSYITIGNGWWTAPVVLGWGTVSDVIVRGSAVAPVGSSICRSGSTSHWHCGTVLGLNETINYAQGAVYQATHTNACAEPGDSGGSFITGDQAQGVTSGGFGNCGSGGETWFQPVNEILQTYGLSLVTG

SEQ ID NO: 44096 - protein, 227 aa, Streptomyces sp. AA4
MGRHSKPSKTKTALQRTGATAALAGATLGGIGLAGAGTANAFPGQAGIVKCESSGNPTAVNNTAAGQRAGRPAGLFQIVTKTWLANGGGQFAPTADKATPAQQQIVADRIYAKQGSAPWQCRGGSGPASYADFGGDTSGGSAEVEASVAKPKVEVEVKAETKVKSAPKHAAPASNPDGSYTVAAGDTLSGIAQNLGVDGGWQHLQQLNAKYIPDANLILVGQKIVTK

SEQ ID NO: 44097 - protein, 208 aa, Streptomyces sp. AA4
MSYRGKHRKMSAATRTIARVAVAGIAVGAPLAIAATPASATNWDAIAQCESGGNWNTNTGNGYYGGLQFTQSTWKAYGGTGSPQGASREQQIAVAERVMQGQGPGAWPVCSKKAGSSASAHKATPKKSTATKKATPKSDAPKKVAQPVAALVANSNPNGDYTVKAGDTLSKIAKENNIQGGYQKLQDLNKQYVSNPNFIVVGQKLATK

SEQ ID NO: 44098 - protein, 424 aa, Streptomyces sp. AA4
MAGIVRVRGREVLDSRGNPTVEVDVVLADGSAGRAAVPSGASTGTREAVELRDGDAKRFHGKGVRKAVDAVNGEIADAVIGMEAEAQADVDRALIALDGTENKARLGANATLGVSLAVAKAAAAANTLPLYRYVGGVYAHLLPMPMMNIINGGAHADNPIDFQEFMIGPVGAETFADAVRMGSEVFHTLRKSLHEAGHNTNVGDEGGFAPQLGSADEALEFVVRAIEQTGYEPGKDIALLLDPAASEFYRDGVYDYTGEGRKRSVEEHVAYLTELTERFPIVSIEDGLAQDDYAGWKQLTDGIGDRVQLVGDDLFCTNVEILRDGIKRGIANSILIKVNQIGTLTETLSAVDTAHKAGYSAVMSHRSGETEDTTIADLAVATGCGQIKTGSLSRSDRTAKYNQLIRIEEELGTEARYAGWDTLR

SEQ ID NO: 44099 - protein, 696 aa, Streptomyces sp. AA4
MTSRRGLATGIASVAGLALSLLALPVTPASAAPAQPSADPQATAIAAADRAAAAGAVGLRKSSAESLHRVSTTLGDAGLYYNSYERTYDGLRVVGGDAVIVADGTGRVRGTDSAESAAITVGTTPAVDAARAASVARGQLPTVSAVSKPDLVVLGGAQPKLAYEVVVKGRTAKAPSNLHVFVDAATGKVLDQRDDVKAESPAKAASNAAAPRVAGNGNSYYAGQVSIDTSGSGSSYSMRDPNRPGISCGREGGSVFTKSSNNWGNGQGTDLETGCVDVLYTVQTEWNMLKDWLGRSGIDGNGNGFPASVGLNDVNAYWDGSSTHFGHSQDNQRQATSMDVAGHEFGHGIFQNTPGGAGSGNENGGLNESTGDIFGALTEFYANNPVDTPDFTVGEGVNLVGNGPIRYMYDPSREGDPNCYSSSIPNTEVHAAAGPQNHWFYLLSEGNAPTDGQPASPTCNNSSITGIGIQKAGKIFYNGLLHKTSSWNHKAARKATLQAAVDLFPGSCTEFNATKAAWDAVSVGAVSGEATCTGNPPAGNDFSVSLSPSSATVQPGQSATSTVTTKITNGNAQSVKLTASGLPSGATATFNPATVQSGGTATVTIATTASTPNGTSKVTITATGANATHTADFTLTVGSGNPGGCGGVTAWDANKFYGPGDVVSYKSHKWTSSWYSVGAEPGAPGSWAVWTDSGAC

SEQ ID NO: 44100 - protein, 292 aa, Streptomyces sp. AA4
MISLPSKGIPSPHRGAGMDEDRKFSRKAVLKAALAAGVAAPVALVGGPALARTNFAGGQKVEPTPYCHDGDEPTIDQTEGPYFKPDSPERSVLVDQNTPGQRLTVSGYVFGLSCQPIGRALLDFWQADVNGAYDNDGFNFRGHQYTNDLGEFKLTTIVPGLYPGRTRHIHVKVQAPGEPILTTQLYFPGEPRNNTDTIFDSRLLMTVRDAPNNAKEAAFDFVLNVQQTPTGGPSTGPTSPTGQPGGTTWTAGKSYPAGTRVTFNGVSYVCLQGHTAQRGWEPPNAPALWQKG

SEQ ID NO: 44101 - protein, 178 aa, Streptomyces sp. AA4
MTLHRFGRLAAGAAAALVLPLTGAGTATAAPLDAVELYYDASGLPDYQAEATQAAANWNNSVHNVHLNSGGAATIIMHETTGGGSYTQTDGHGNGDIYIDTQQVAEGNDPTRIIAHEIGHNLGLPDHYEGPCSELMSGHGPGITCKNAMPDAQESAQVDANFANGFAAVRLPEKHIYR

SEQ ID NO: 44102 - protein, 214 aa, Streptomyces sp. AA4
MGGHNPGASAYFGLSARKPGKLPDPPRSFLMSRKFVLSGAVALALAAAPLSGAVAVAAPAPSAVAAATVYYSTSGAPSFRAAINAGAANWNRAVTNVKLVERSSGATLRYVEGNDPRGSYAQTDGHGHGTIFIDYTQARQYDNTRITAHETGHALGLPDHYSGPCSELMSGGGPGPSCHNANPNSQEASRVQRLWANGLSAVSGPQQRIYDHAG

SEQ ID NO: 44103 - protein, 354 aa, Streptomyces sp. AA4
MRVVPPVGFSPPGGRSMTSRKTLVAGCTALSAAALTAGMCVNAASASPMAFAQMQAKAITQATQIADTLGAGNGGIYLERGKAVLNVTDAAAQEKAKAAGFATKLVKHSFTALTGAKNQMDTVKNVPQTSWGIDTKTNQVVVKIYDSASQATKDKVAAAAAKLGDAARVEHRSGKLATYIADGDSINNGQFTCSLGFNVTRGGQPYMLTAGHCTNEGGTWSGGDVSGAQVVESDCPGADSGLLTRPNGTGPGAINTGQQITSAASPTVGEQIQKMGQTTGGGSGEVTSVDESVNFDVGVLNHEFGTTAHTDHGDSGGPAYDGDKGLGTLSGGDTQTSYFYPLTLELQSYGLELA

SEQ ID NO: 44104 - protein, 278 aa, Streptomyces sp. AA4
MRPALVAGLTAASALALVLGTPALSAAAVPAPLAASASVLGSGGDLASPEKKEIAMQLVSSAENSSLDWKKQYAYIEDIGDGRGYTAGIIGFCSGTGDLLELVRAYTKAVPDNPLAKFLPALEKVNGSDSHEGLGSAFESAWKQAAGTEEFQAAQNSERDRGYFDPAVNQGKSDGLGALGQFIYYDAIVMHSPGTSTDSFGGIRDAALSQAKPPAQGGDETAYLKAFLDARKVVMKKEEAHADTSRVDTEQLVFLNDGNLDLHPPLKWKVYGEPYEIN

SEQ ID NO: 44105 - protein, 420 aa, Streptomyces sp. AA4
MLTAFIFRMFAGGQMQRSRLAATLVAAATVAGAAAVVAATAHAQTGATTGLDNNWYASAPYLMPQSNNPPDPVTVMNATGQKAFQLAFILAPKGGGCSPTWDGTSPVSSDTTVGDAINRIRGNGGDVSVSVGGYGGTKLGQTCGTVDATAAAYQQVVAKYNLKAIDFDLEEPEYEDTAAIANELGAAKKLQADNPGLFVSVTMPGTAAGTGWFGTQLLDQAKSIGFSPNNFSIMPFDGGFTGGGASQVSALEAFHGLLQSHLGWDSATAYSHEGFSGMNGKSDSSEYFNVSDFQTVYDYATSHHLGRFTFWAVNRDRQCTTTTDNSVCSNVQQNDWDFTKFTTRFAGATPPQTTPPTSPTSPTSNPPGTCSAPEWQKTQVYTGGNVVSHNSHKWTAKWWTQGEEPGTTGQWGVWTDNGSC

SEQ ID NO: 44106 - protein, 246 aa, Streptomyces sp. AA4
MWSMSHVLSVRGMTNRVRTARRAAARALLLVVAVLGMELVVTGAASADPASGTWAKLRMCESSGRYSINTGNGYYGAYQFDLPTWRSVGGQGRPDQASPREQDYRALYLYRMRGWQPWECGGMLGLSNDGDARSKRVPSWEESAYIGGGGLPTPPAPKPPPTPPPGPPGATPAWPGLVYAYGDCAPALRTFQLRMNAFGYGFSGTGCYYDKTRTAVLDLQRANGINDSGRLGPKTWKAAWEGKAPR

SEQ ID NO: 44107 - protein, 179 aa, Streptomyces sp. AA4
MAPPRTPKLLMTACLLFSVAACGGVNAREGSAAMGAGNPAAQPAAAQASGDLQFGANHRFASGITVSLSAPQSFQPSPAAYPRSPRAAAFYIQVTNNGTDPYRVSALSVTATVAGKPAKQVVDATQGLGGVSDAGKDLLPGRSTQVTLAFAVPEDSARIAVQVRPSTGEPAVVTYCGDA

SEQ ID NO: 44108 - protein, 365 aa, Streptomyces sp. AA4
MKAIRFLGAATAAAAVTAIFAGVPAATAAPLNPDMVPAMQRDLGLTHSQALARLANEEAANKVGAALENSLGERFSGTSFNAATGKAVVSVTDAALVDQVRAAGAEAQVVRFSARQLDSTVQTLNAHEKAAPKSVTGWGIDTAANRISLTVLKGQRGAAEQFVRESGVDGSAVTVTETSAVPKAHYNVLGGDAYYIGSSSRCSVGFSVNGGFLTAGHCAALTGGGALSGYNRVAMGQFSTYRFPGADYAAARVNSNWTPVGQINNGTRVAGSTEAAVGASVCKSGSTTGWTCGTIRAKNQTVRYQEGTVTGMVLTNARSDHGDSGGSFISGNQAQGMVSGGDTVNSYYYPVNVALSATGTTLVRG

SEQ ID NO: 44109 - protein, 289 aa, Streptomyces sp. ABRIINW 18
MSLLVALGAIVAALVVLPAATAQAATCATAWSSSSVYTNGGAVSYNGRNYTAKWWTQNERPGTSDVWADKGACGTGGENPGENNGFVVSEAQFNQMFPNRNAFYTYKGLTDALSAYPAFANTGSDEVKKREAAAFLANVSHETGGLFYIKEVNEANYPHYCDATQSYGCPAGQAAYYGRGPIQLSWNFNYKAAGDALGINLLANPYLVEQDAAVAWKTGLWYWNTQNGPGTMTPHNAIVNNAGFGETIRSINGALECNGGNPAQVQSRINKFTQFTQILGTTTGPNLSC

SEQ ID NO: 44110 - protein, 295 aa, Streptomyces sp. AJ9463
MIRRIMGLLAALGAVVAMVVVLPATTAAAADCAAPWNSSSVYTGGGTASYNGHNWTAKWWTQNETPGSSDVWADQGSCGGGGGTDPGNPSGFVVSEAQFNQMFPNRNPFYTYSGLTAALSAYPGFANTGSDTVKRQEAAAFLANVSHETGGLVYVVEQNTSNYPHYCDSSQPYGCPAGQAAYYGRGPIQLSWNFNYKAAGDALGIDLLGNPYLVEQNASVAWKTGLWYWNTQNGPGTMTAHNAMVNGAGFGETIRSINGSLECNGGNPAQVQSRIDRYQAFVAILGTTPGSNLSC

SEQ ID NO: 44111 - protein, 409 aa, Streptomyces sp. AM-7161
MPPTINGCAAAASRPSSPPRPPASCSPPLAGLTSATAAAVNLAANRPVTTSSTESGSFGGAKAVAGSASTRWASAEGVDNQWIRIDLGSATTLGRVVLKWEAAYARAYRVELSDDGSTWRQIHATTTGDGGTDDLSVNGTGRYLRVFGTQRGTPYGYSLYEVEAYGAGATTPPPSSGTGLDDPRKKEVAMKLVSSFENSSLDWRAQFAYIEDIDDGRGYTAGIIGFCSGTGDMLELVERYTAKKPGNPLARYLGALRAVDGTDSHEGLDPGFTNAWRQAAQDTVFQQTQEEERDRVYFTPAVSQAKQDGLRALGQFAYYDAAVMHGESGFRDIRSVALSRALPPSRGGDEKAYLKAFLDAREEEMRKEEAHSDTTRVSTAQRRFLNEGNLDLNTPLHWSVYGEAFSLTG

SEQ ID NO: 44112 - protein, 781 aa, Streptomyces sp. C
MPSPTRTRAMLLASGAAIAGLLVGGLSAGVSHAADNESCRPDGLYKTAGVDVPYCSVYDSEGREKMGADHQRRVIGYFTGWRTGKDGTPAYLANNIPWSKVTHLNYAFAHVGADNKISVGADNANNAATGMTWPGVAGAEMDPALPYKGHFNLLNKFKKQYPNVKTLISVGGWAETGGYFGDDGNRVASGGFYSMATNADGSVNQAGIDTFADSSVEFVRKYGFNGVDIDYEYPTTMKDAGNPLDWQLSNARRAGLVKGYDVLMKTLREKLDRAGAADGKHYLLSVAAPSSGYLLRGMETFQMQKYLDYVNIMSYDLHGAWNEYVGPNASLFDDGKDAELAAAGVYGSAQYGGVGYLNTDWAYHYFRGSMPSGRINIGLPYYTRGFKNVQGGTDGLWGKAPATSCPAGAGLTKCGDGAVGIDNLWHDKDANGVESPAGSNPMWHAKNLEKGVVGDYVTKYGFPANTTLTGGYARKYDSTLVAPWLWNAQKKVFLSTEDEQSVAAKADYVVDKGIGGAMVWELAGDYAYNAAKGQYEAGDTLTSLMYDKFKAATPYGAKKAGATAPPAQAVDIRTEFTEFKLGDSNYPITPKLKITNNTKSTLPGGTEFQFDYGTSAPANASDQSGFGTKVITTGHSGSNVGGLKGDFQRVSLKLPAWQTLAPGASVDLAFNYYLPVSTPSNWTVNISGTTYALAGDLARGTTTGEPGGGSTPPTTPPTTPPTTPPTTPGTCTSPAYVAGTVYNSGSVVSHKGHTWKAQWWTQNEEPGTTGQWGVWKDQGAC

SEQ ID NO: 44113 - protein, 285 aa, Streptomyces sp. C
MPVPEEPTATPGPAGGGGRVSRKTVLRAAAALGAAPLLIGGRVALARDQPASGGAALAPTPDCHDGDEPTVEQMEGPYFKPDSPLRDSLITSGTPGTRLTVTGYVFGRACRPIPGVLLDFWQADHTGAYDNSGYRFRGHQFSSARGSFSLTTVVPGLYPGRTRHLHVKLQAPGRRVVTTQLYFPGEPRNSTDTLFDSRLLMNLRQAGPGQEGTFDFVLDVPQDPTTPPTTPPPTTPPPTGTWTPGRAYRAGDGATYAGLAYRCLQAHTAVVGWEPPNVPALWQRL

SEQ ID NO: 44114 - protein, 844 aa, Streptomyces sp. C
MIHSPKSGTDIRPTPRPAPALRFHGGESCRRPSEAVRPVQFYMSHVNCRCRHHRPQRPRRPPQMHPSRISKAGARRLPALGAAAFIALGLLTPQSHAAPVGATTPAGAYAGPAAAPAPRSIPVPKSPDAMANGSRLRISSQDSTEETGPAPAPAAKADKPAKGDRQSSSASAAAGNECGDLAGVINATGGALVQQLKALPQITCTYPLFGLTGENARKTFNEAKMVTVAGALRDASAGYAGDNRAAIGQLVLFLRAGYYVQDNNADAVGPYGTALDGAARGALDAFFASPRSRDVTDANGEILNEVVTLIDSTHTAGRYAGVVKWMLGGYDSTWPGQMDLAMQHVEWVVENGFKAKDDGRGWRAALKADPAILDTWAGFITRNGAQLNRLDVVSNVGRHLGNALDVPELKDRLRPLLKDLVNRYPNVGPTAPITMNLGWYTRQYDRGNCAAYALCDLGERVLPAILPTQHTCTPGLKIRAQDMSPGQLSGTCTSLVNQDAYFHRIIGDKGAVPGDLNTDLEVVVFDDYTNYSLYAWAIYNIDVDNGGMYEEGDPAAAGNQARFIAHEAQWLRPAFQIWNLNHEYTHYLDGRYNMAGDFEAGMTTPTIWWVEGIAENISFGYRGERNADAIAAAGKKTYKLSELFDTVYGQDEDPQVNSDRVYRWGFLAVRYMLQAHPADVQTVLGKYRAGDWNGARTFLKQTIGTGYDAGFAAWLTTACATDGCGPLPDAAPATPLCTSGDPRQFDGNCRRDGLAAGAGNHSYHFVYLPAGVKQLTITSSGGTGNADLYYNGGNWATTSSYQAKSATAGNGETLTIDNPPSGWVYFSLAGAQDFSGVSLSTQSR

SEQ ID NO: 44115 - protein, 192 aa, Streptomyces sp. C
MFLGTCVKIGTSAAALVLAAATAATAAPAPAALPGTAAAAVTLRYDDSRAGGWEAAVAAGVASWNANVSNVRLVKAAPGVRAEIVIVATTGWPQATLGPVRPGRQVRVELGAEAVSQGYDKTRITAHELGHSLGLPDTKPGPCTQLMSGSSAGTACTNAVPNATERSRVQYAYASGLAAVAPADGRVLVDAP

SEQ ID NO: 44116 - protein, 306 aa, Streptomyces sp. C
MIRTLRSRALSLAAAAAATLGLAVALPASPAAAAPACAGAWSSSAVYTGGAGVSYGGHNWQAKWWTQGETPGTTGQWGVWSDQGACGGGGQEPDPGTGNPSGFVVSEAQFNQMFPNRNPFYTYNGLVAALSAYPGFANTGDDTVKRREAAAFLANVSHETGGLVYIVEQNTANYPHYCDATQPYGCPAGQAAYYGRGPIQLSWNFNYKAAGDALGINLLANPYLVEQDPAVAMKTALWYWNTQNGPGTMTAHAAMVNGAGFGETIRSINGALECNGGNPAQVQSRVSKYQSFTQLLGVTPGSNLSC

SEQ ID NO: 44117 - protein, 133 aa, Streptomyces sp. C
MALTALTALAGTGAADAAPTGTQSLYSPSALVVSVTAGEDTANGTVLRAATLVCAPRPGGTHPAPAAACAELRATGASLDALAAPRPDTACTREWNPVTVTAEGVWEGRRLSYTYTFGNPCGLRSTTGVLFGI

SEQ ID NO: 44118 - protein, 350 aa, Streptomyces sp. C
MSMPRTPRGLLATATAAVALLGLAVPASATAPRPAGGALPQGRLFMVNPVQSSGDQTLTDAKDSAAAIPASAYATAALRNLDSSGGLSGRWASVRSETGASASVADAARYDRSDDQFEQVMAYFWVNEAQEYLQGLGFGSELPGANDRVQPVRINQWGADNSFFTDKKAEIRFGKGGVDDAEDAEVIVHEYGHAVHHAQVPGFGSSPEAGAIGEAFGDYLAVEVGDHAATAYGWPRAADRACVADWDSVPYSPAPHCLRRIDGTKVYEDRVGEVHADGEIWSRALFDIRGALGARTADRIIVNAQFRFAPDTGFREAALATIDTARSMYGQSAADAVTAAFKSRRIPGIQ

SEQ ID NO: 44119 - protein, 284 aa, Streptomyces sp. C
MLALAAGLAATAALAAPTAASADDNGNGFSAARLAAAGASVLRADVAGTAWHTDPATGTLVVTADSTVTGADIARIRREAGPDAAALRIERTPGKLTKLLSGGDAIYASSWRCSLGFNVRSGSNYYILTAGHCTEGAGTWWSNSSHTTVVGSTAGSSFPTNDYGLIKYASNSPVPPGTVGSQDITSAVNATTGMSVTRRGSTTGIHSGSVTGLNATVNYGGGDIVYGMIRTNVCAEPGDSGGPLYSGSRAVGLTSGGSGNCSSGGTTFFQPVVEALNAYGVSVY

SEQ ID NO: 44120 - protein, 329 aa, Streptomyces sp. C
MPQISHRRARAAATAVAATAAAALTLTAAPAATAAEDSATPRLSVLTYNVFLMSKSLYPNWGQDHRAAEIPRASFFQGHDVVVLQEAFDNGASDALQANASAQYPYQTPVVGRSKSGWDATGGSYSTTTPEDGGVTILSKWPILRKEQVVYKDACGADWWSNKGFAYVVLNVNGTKVHVVGTHAQSTDPGCGAGEAAQMRSRQFKNIDAFLDAKNIPANEQVIVAGDMNVDSRTPEYASMLADADLAGADTRTGHPYSFDTAQNSIANYRYPTDPREDLDYVLYRKANARPAGWENNVVKEQSTPWTVSSWGKSYTYSNLSDHYPVIGR

SEQ ID NO: 44121 - protein, 273 aa, Streptomyces sp. C
MLGAALLTAPVAAHATAAPPAAPAPGATAAAATAAAAATGLDDPAKKDIAMRIVSSAENSSLDWKAQYKYIEDIGDGRGYTAGIIGFCSGTGDMLDLVEYYTKVKPGNVLAKYLPALRKVDGSDSHAGLDPNFTGDWAKAARDAEFKKAQDHERDRVYFNPAVGQGKSDGVGTLGQFIYYDAIVMHGDGGDSTSFRNIRKRALAKAKPPAQGGNETAWLNAFLDARVWAMKQEEAHSDTSRVDTAQRVFLKKGNLGLDTPLEWKVYGDSYRIG

SEQ ID NO: 44122 - protein, 435 aa, Streptomyces sp. C
MSRTAAPRPRLAVITATALAAVALSTIGAGSAQAASVATWDKVAHCESTDNWSINTGNGYYGGLQILKSTWDAFGGRAYAAYPHQATKKQQILIAEKILAGQGAGAWGSCGAAANLGSDHADPYPGDTTPPAPVSKAGDVYHAIRATDGSWTPFQALNGFGGAAFFNASQESIAATPDGSTQTLATGNDGNLYHTARYTNGQWTGWAALPGYGGAATFGAKDQAMAGMSNGDSNVMAIGNDGKIYQNTRFKSGSWAGWSPVGNWQAKKIAVAGLPDGSTQTLIIGNDGNVYHAIRATDGTWTGWNALPGTGTAATFQAGNIAIAGLPNGSTQMLATGNDGLVYHNIRNADGTLQGWAKVDGYGGAPGFAATSLAITGMPSGDTQMLAVGNDGKAYHAARYAAGNWQGWWATGMGAQKVAIAGLGDGSAQMLATRN

SEQ ID NO: 44123 - protein, 229 aa, Streptomyces sp. C
MGVRGRHRRYQPSSINRASLVVTAGGAGIALPLIGATDAQAASVDTWNKVAACESTNNWQVNTGNGYYGGLQFSQSTWREFGGTAYAPRADLATKAQQIAVAEKVLKGQGPRAWPACGPQAGLSRSGPAPALDPKAPAKAPARPAAEPAAKPSGQAHKDLVRPTKATTATPVSMPRPTGTPVLPNPYVVAPGDSLSTIASQQHVEGGWQALYETNRFHGRRQPQPDLPG

SEQ ID NO: 44124 - protein, 152 aa, Streptomyces sp. C
MRRRPGRLLGPLLVLLLVGAGPDGSGETVSLDGDRPGERLDVTLTRVVDPAGRADAERLVAVELRLENTGSVPYEDSPAPAAHLLDTEGRRFTGTGTATGAGPSLPETVSLEPGGSASGFVTFRVPEGAGLAAVQFALDAGLGDDVGHWSLS

SEQ ID NO: 44125 - protein, 190 aa, Streptomyces sp. C
MQPPQKSNAGKIIGFGCGGIVLLSLVLFACGAVVTGASKSSAKKDTPITVPTASGAPSAPNAAPMQPAPGNSDAPAGTADKNADVTLTASPTPFKPSILAQSGDYTSVQVTIVNNAAKQVDVNVFYFEVTGEDGTRRQIELAAAEDQIDTVKLAKGEKATGTITVKGKITAKTVTFRNGFVGKSYTAPVK

SEQ ID NO: 44126 - protein, 119 aa, Streptomyces sp. C
MAEAKPTSLYAPSAMVFSVAQGDDASAPVLRAATLSCMPTAQGTHPDPKAACTALNSTGGTFDRLLAAPDTNRACPMHYAPVTVTAEGVWQGSRVAWKHTFSNACSMNATLNGNAVFAF

SEQ ID NO: 44127 - protein, 455 aa, Streptomyces sp. C
MLKRHARAACTALAAAGLLLAGTTAAGAATPAADPAAPQKSATATLRPGDAPAELLTALQRDLGLTPTQAKDRLAHEAEAGATAARLRARLGAAFAGAWVDGADSATLTVATTRAADAAAIRAAGAEAKLVSRSLADLDAVRAGLDRAATAETPVRYVDPRTNTLVVEETRPGAAAGLLAATGTDPALATVVRTAAEQAPRPLYDLRGGDAYYMNGQGRCSVGFPVTRGTTQGFATAGHCGRAGTTTSGFNQVAQGSFQASVFPGNDMAWVAANTSWTATPYVKGSGGANVQVTGSVLQPVGSSVCRSGSTTGWHCGTVQQHNTSVTYPEGTISGVTRTTVCAEPGDSGGSYISGSQAQGVTSGGSGDCTSGGTTFFQPLNPILSAYGLTLKVTGSDPGPGPGPGPQPGGTWKAGTVYAAGDTVTYGGAAYRCLQGHQAQTGWEPSVVPALWQKL

SEQ ID NO: 44128 - protein, 565 aa, Streptomyces sp. C
MHIRKPLIAAAATAALAAGALATFAGLGTAQAADASSTAAAGGVRIAYYDQWSVYGNAFYPKHLDTRGIAGKLDVINYSFGNIHPTDLTCFEANKAAGDDNNPNAGDGAGDSYADYQKSFSAADSVSGAADKWDQPIVGVFNQFKQLKAKYPHLKINISLGGWTYSKYFSDAAKTDASRKKLVSSCIDQYIKGNLPKADGYGGPGTAAGIFDGIDIDWEYPGSSGGHLGNHYAPEDKQNFTLLLKEFREQLDAYGQANGGKKYLLTSALPAGQDKIKYIETDKIGAYLDYANIMTYDMHGAWDGDGPTYHQSPLYSGTNDPTDPIAPGTQKYSIDNAIDSWIDGNPAYGITGGFPANKLTLGYEFYYRGWKGVPAGAAGGLAQPATGASGARPTSQQAGIANYKELGGIVDNPATTYWDDQAKASYFYKDGEFFTGLNQKSIQARVDYGKQRGLAGAMMYSLLGLDNNTTLLNQISDALGGTTVPPTTPPTTPPTTPPTTPPTTPPTTPPTTGCGNVPAYVPGTVYTAGNEVSHNGRKYKAQWWTQNEVPGTTGEWGVWKDLGAC

SEQ ID NO: 44129 - protein, 221 aa, Streptomyces sp. C
MRHSRRNMLSAAAVGLGVAAALGGVVPTAGAATASPAGSPASYAAYERSAENDAATRAFFEAVKRSVAEQRAANPGALAVTVTYNTRNAPSFRTQIANSTRIWNGSVSNVKLQEVSSGGNFSYREGNDSRGSYASTDGHGRGYIFLDYRQNQQYDSTRVTAHETGHVLGLPDHYSGPCSELMSGGGPGTSCTNAYPNSTERSRVNQLWANGLVASGLDAKG

SEQ ID NO: 44130 - protein, 426 aa, Streptomyces sp. C
MPSIDVVVAREILDSRGNPTVEVEVGLDDGSTGRAAVPSGASTGAFEAIELRDGDPNRYMGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLHNKGLSTGLGDEGGFAPNLESNRAALDLIIEAIKQAGYTPGKDIALALDVAASEFYKDGKYEFEGQSRSAAEMTDYYAELVEAYPLVSIEDPLFEDDWAGWKTITDRLGSKVQIVGDDLFVTNPERLARGIEEGSANALLVKVNQIGSLTETLDAVEMAQRNGFKCMMSHRSGETEDVTIADLAVAVNCGQIKTGAPARSDRVAKYNQLLRIEEILDDAAVYAGRSAFPRFKG

SEQ ID NO: 44131 - protein, 245 aa, Streptomyces sp. C
MLLSGKGKHRRGSKAVRIVTLAGVAGVAVAAPLMAAGTASAATSAEWDKVAACESGGNWSINTGNGYYGGLQFSASTWAAYGGKAYASQANQATKGQQIAIAEKVLKGQGKGAWPHCGVGLSNSAYNGGGSTTPAKPKPETKPAPAKPAPAKPAPAKPAPAKPSTPKAETETKGSGSGSGNWTPAKPSTGTPATGGTYTVKEGDTLGTIADANKVKGGWEKLFELNKDTVSDADLIFPGQKLKLA

SEQ ID NO: 44132 - protein, 359 aa, Streptomyces sp. C
MLPGNGRHRRPRQVPAIVVTAGVTGSALAMPLLAATGANAADTATWDKVADCESGGTWSANSGSGAYGGLQFTLEQWRNAGGLAYAERPDLASRSQQIAVAERVLASQGPQAWPLCSASAGLTQQGPAPEVDPGDKLNPGPVAPTPTRPDDSVPKTGKGKPSTDFGAPTPAPGTASNPSGLPDYPLGPSSGLPVMPEPDFTVQPTTPGTPTPGTPTPGTPTPGTPTPGTPTPTAPGTPTAPGATPTAPATPGATPAPGVTPTAPATPGATAGTPSDAAADGSGKHRGPAAIEVQAAPGTAAAPAADPVYTVKPGDSLSDIAKAKGVEGGWGELYKANEQVIGGDADLIKPGQNLDLTKK

SEQ ID NO: 44133 - protein, 254 aa, Streptomyces sp. C
MRQLGVRVEGAYLSVPRTATVPRSGLTLGVRTERGVTFMADGRERTIRTNAATVKEALDQAGITLHGQDTTSVPPDSFPRDGQTVTVLRITGTREVREERIPYATERVEDAGLFAGTEVVDRVGRPGARRVTYALRTVNGVRQQPRKIAEEVVREPVSQRVLVGTKPLPTSVAGADGLNWSGLAQCESGGRPSATDPSGTYGGLYQFDVSTWQALGGSGRPQDAPASEQTYRAKKLYVQRGASPWPHCGRRLER

SEQ ID NO: 44134 - protein, 191 aa, Streptomyces sp. C
MPFLLFTATACQSAPEGAALAPAAAPAVPVDDGAPGADEDPAAQDRAGGATGAAKDAHVGDSVRVQGHEVGRHLQVVLSAFVDPAVSVEPNYQPPAGKRWVAASMSFVNVGGASYGALGRMWAYDGAGKRHPVVRTGELTTGKPLVFDSLAVGERAEGWVVFEIPENQKIVRLQYQDANMQANSGGGFWSV

SEQ ID NO: 44135 - protein, 796 aa, Streptomyces sp. C
MFQHRAVRTSLLATAVTVTLLATAGQASTQAAERATPTGTFSAGVQGATADTAPNPFDEVDRRADAEPLVPAPAPAPGGKAVTDGRVPGAAPVVEAPGSTAAAERTEKSVKSAQAAPTAKSVAAGVPCTLDGIKNLTPEQFADFLGDQAVTADGCLRGLIWTWDARLAPVMSDAHVQAVSRRISSLAAAHDGRNSSHLEEMFTYLHAVAYHDFSRDEIDVTDAPTTAAIRQAIDDFGNAARTFDVTPTNARTLREALYAAGPGLRHHQIGLIKKVLATMDPAHPATNLDAGWAGAVLAALSTNYLGVYPGNQDAAFHAAVAGDASYRAAFKAFAGYTHLKGSGNAWVVRDALSEYARFGQVGGLKDQVIADLGAMLDRVKSDHGTDAWAKIVSWLNFYGACKQYGVCKEDIEKQLFPYTYSYDNGAIKVRTALDKATVDQLYYASKQVKTQFHRVIGTDQPLAGDPNSTLNIVLYASRADYENYHPILTGYGTNNGGIYIENGATFYTYQRRVPQDSSLTLEELFRHEYTHYLNGRFAVPGSFGQGPWYEGDRTTAMDEGTAEFFDGATRDNGIAVRKSLVKSVINDTAGGGPRMTVEQLLNATYDGDGFRFYSYAGTFFEFLWTEKPSLLREMYGYLRANDVAGYDAWRHRTGADTYLQRDYNRFLDAQIAKVDQLYVPNTTFTPNERLRDAALASVKSSFAAATYNTPDCVENGDPGKRRFTCTGRITANLKNWRSDDQNFKDMSETVDYFILDRAGAASNNLADMNCSFGPVEIWDNKAAATSSYSCEGPLRS

SEQ ID NO: 44136 - protein, 312 aa, Streptomyces sp. C
MRAMAVVTALFIAAIAASPAQAAQADPPPDHAFSDPGQRPAHGIAKGAPGAAGTAGGKLESRILPIVHNCSPSLRIRAQEMTAAQLTATCASLANQDAYFHSVVKDSGPVPDDNNTTLEVDVFNSSADYKAYAGRIYGIDTSNGGMYLEGDPARTGNQPRFICYERTDVSPGWQIWNLNHEYTHYLDGRFNLYGDFDAGQSTPTVWWGEGIAEYVSYSYRGVTYSNALAEAGKHTYSLRTLFDTTYANSDVNRTYNWGYLAARYMVEEHPADVATVLGHYRDGNWTAARSLLTSLDYESDWNAWLTSVATAA

SEQ ID NO: 44137 - protein, 433 aa, Streptomyces sp. e14
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKAKGLATGLGDEGGFAPNLGSNREALDLILEAIKEAGYVPGEQIALALDVAASEFYKDGKYLFEGKERSAAEMTEYYEELVAAYPLVSIEDPLFEDDWAGWKILTDRLGDKVQIVGDDLFVTNPERLARGIEEGTANALLVKVNQIGSLTETLDAVELAQRNGFKCMMSHRSGETEDVTIADLAVATNCGQIKTGAPARSERVAKYNQLLRIEEILDDAAVYAGRSAFPRFRGNTRISKG

SEQ ID NO: 44138 - protein, 245 aa, Streptomyces sp. e14
MFSSKGKHRRPAKATRVIALAGVTGAAVAAPLMAAGNASAATASEWDAVAQCESGGNWSINTGNGFYGGLQFTNSTWAAYGGTAYASRADLASKSQQIAVAEKVLAGQGKGAWPVCGKGLSGASYSGGTSSSSSSSSSSSSSSSGSSSSSKSSGSSKSSTATRSTEQQSANRSATRPAPKKTVTTPTGKKVAKGDGEYKVVAGDTLSSIAAAHHVQGGWEKLFRLNKDIVQDADLIYPGQQLHLK

SEQ ID NO: 44139 - protein, 375 aa, Streptomyces sp. e14
MLSGNGRHRRPRQAPALLVAAGVTGSAIAIPLVAASGASAADGTTWDKVAQCETGGSWSADNGNGYYGGLLLTQDDWEEYGGLAYAASADQASRSQQIAVAEKILADRGPGAWHTCGLLAGLTKSSGAADVDTGVGGSPSTAPEKGATDTGKSSGSSGTSGSSDSGDPGLSDSSQGSSNSADSSGSSAADGDATDSSSGTPGTSRSADRPDDPAAQQPTSPSSPTKKDDTAKSDTSHTSGTPGATPSTDAGSGGYGDSDYSANPQQVVGSSALVDTGALSGGRHRGGSAAEDPAGDSAAAAGGRHASRADGLTTDTAGGSYTVRSGDSLASIADSLDVSGGWHALYAANQSAVGSDPNHIAAGQTLDVPTENVAK

SEQ ID NO: 44140 - protein, 451 aa, Streptomyces sp. e14
MERVGVSRTPYETYEIPYQIPREIPQEMPYGIPYGIPETGGEVAPGDTYRPAYEARAALPRQSRQVRRDGAGRGLRRRGGRPAYRTRPETGVRRLLPQALVVAFLAGGTTAFVAKDKAVELNVDGRPRTLHTFADDVTGLLAEQGVPLGAHDAVTPAPGAALSSGDAIEVRHGRPVRLTLDGRRYEAWTTARTVGEALREWGVRAEGAYLSAARSRTLGRAGLTLEVRTERTVTVMADGRARTVRTSAATVAEAVSEAGVALRGQDALSVPPDSFPREGQTVTVLRITGSREVREEPIPYAVRRVADPALFEGTEVVERPGRPGVLRVTYALRTVNGVRQRPRRVASEVVRAPRTELVKVGTGARPRSVRDADGLDWEGLARCESGGRPDAVDPSGTYGGLYQFDAATWHGLGGRGRPEDAPAAEQTYRAKKLYVRRGASPWPHCGERLHS

SEQ ID NO: 44141 - protein, 342 aa, Streptomyces sp. e14
MGIPRYLTFDPADSKIPPNPQYPWHYPVLVVHILAGTVAIVTCCLQVWPALRRRHPRVHRLSGRLYVAAVLSGGPAALAVAYASPSGLSMQMSTMTTSVLWIGTAAAGLRMARQGRIAEHRRWMVRSFALTMSIVLSRVLGVVYDHTILPPPVTQNVAELIAWGQQRAGLASWPGWILPLLFAEWWLVERGAGARHRARAARRKAVAPADVRSAPSPATTAHGPRGRLPAGRRLVPVGVPSARGNSAPPARPAGRTAAAGGTGRLGERWPAGAVQRAAGRAGRGRGRWSEREGLAAAVARRRLDGVQQPVDAHRGGEVRAEGVAGADRPGQVRVHLGHVAHG

SEQ ID NO: 44142 - protein, 243 aa, Streptomyces sp. e14
MACVIGALAAPVLAVSLPASSASAHGWVTLPTSRQEQCAEGVVSCGQIKYEPQSVEGPKGLFSCSGGHAEYAELDDDSKGWKATPVGSSATFTWHNTARHATANWQYFIGGQKIAEFDGHNAQPGADVSQQVDFGSFTGRQKVLAVWNIADTANAFYSCVDVVIGGGGDGGGSGGGTGGGDGGGTGGSDTCTAAAWDPARVYNGGDTVSYGGHTWRAKWWVTGDKPGTTGEWGVWEDLGTCPA

SEQ ID NO: 44143 - protein, 541 aa, Streptomyces sp. e14
WEWGRGPRRPAKLSQGLWDLCPANPRPQEQVGLAYAGWDRLLTRVALPAWRMGRWPSRLDAGVVAALTELSRRDRLAEGFASRLGERPACDLLEEPGAVDEATSLLAARLFHGGPAEQGPDWAPVDWQAYPEEVVDRKWRTDAARLHRVLDALGVPHCPTPSAIDPHGPTLARVLDHLSVPPRPAAAPPPPTRPPTAADGTSAIPPHPIRTAPPTAIPGSPATSADPAHPARPARPARPADPADPEAVSAGADAGDDAMTEDLEQALRRGLEEGLMDADATHDTDDTPRTAPLDQPDRLDQPAPSDQRDPRHQPAPRHQPDALDPWDRTDQTDWTDQADWTDQFAQSDRADQSNWTDQIAQTDRPDRPDRPDQIGPTDHIVPTDPTDPTHAPDDEEEADLAGGLANERSAALAAGLTAELAREEAAAPAARTAAQGAGGQGAGAPPWDQDSLPLFPLQPPRTGRELLADHVTAMVCCAAMDTAGAVPGLDWLDGPTLLVDGVRATDLGARVLALVEDGDPVPLRTWLIDSGIRPEKPVRLG

SEQ ID NO: 44144 - protein, 381 aa, Streptomyces sp. e14
MPISRLQSTLAAMAAAVVLPLAAAPSADAASVSTWDKVAKCESSGDWSYYRAGWPYYGGLQFSKSTWDAFGGRQYAEYPYQATKEQQIRIGEKVLATQGEGAWPTCGPPAGLGDDHADPYPAEPPAPQSAMAHITPVKDLTGDGVPDIVTVEKTTGDLYRYSGPDYGGSARVRIGYGWNGMSEIVGVGDITGDGVADILAVDAETGNLYRYSGPDYGGRSARVQIGSGWDSMTSLAGVGDITGDGVPDLVAVEKSTGDLYRYSGPDYAGRTGRVQIGTGWNSMTNLAGVGDITGDGVPDLVAVEKSTGDLYRYSGPDYAGRTGRVQIGTGWNSMTNLAGVGDITGDGVPDLVAVKTAARYLYRYSGPSFPGSSAVKIGTDW

SEQ ID NO: 44145 - protein, 228 aa, Streptomyces sp. e14
MPATPACDDGDGPTHDQIEGPYFKPDSPLRTDLVTAGTTGTPLTVSGYVFGRNCVPLAGVLLDFWQADDAGNYDMAGYTLRGHQFTDAKGAFTLTTIVPGLYPGRTRHLHVKAQAPGRPVLTTQLYFPGEPRNTTDSLFDATLLMNVRGAGGGKEGTFDFVLNVDGTPGPGDPTDPPTDPPGGTWAPGHAYAAGDRVTYNGVAYRCVQAHTSMTGWEPPNVPALWRRE

SEQ ID NO: 44146 - protein, 359 aa, Streptomyces sp. e14
MKHRRIPRRRTALAGAGIAALVAAGVTFQSANASEPARTPEARVLSAPAAGKLASNLLKNLGTDTAGAYYDAGARNLVVNVLDRAAADRVEQAGARARIVEHTLAELDGARTTLAERATIPGTSWAVDPVGDKVVVTADRTVSEAAWAKLAKVVEGLGTKAELKRSNGQFKPFVAGGDAITGSGGRCSLGFNVVKDGQPYFLTAGHCTAAISTWSDSSGTVIGNNERSSFPGDDFGLVKYTGSVDHPSAVDLYDGSTQEITRAGEATVGERVTRSGSTTHVHTGTVTGLNATVNYSEGTVSGLIQTDVCAEPGDSGGSLFDGDTALGLTSGGSGDCTSGGETFFQPVTEALSATGAQIG

SEQ ID NO: 44147 - protein, 334 aa, Streptomyces sp. e14
MSGAHNIRNPDAPGCASRAPTPRGPPTSFVEDRKVRIKRTAPRGITRQTRAVAIAAGLVAAAAFAVPSANASDTDTFSAAQLTKASDSVLKADIPGTAWVVDSKTNRVVVTADSRVSDAQIARIKQQAGTDSGALTIKRTSGKFNKLISGGDAIYASSWRCSLGFNVQDSSGNYYFLTAGHCTDGAGTWWSNSSHSTTLGTTAGSSFPGNDYGIVRYTNSSVTKSGAVGSVDITSAATPSVGTTVYRRGSTTGIHSGRVTALNATVNYGGGDVVSGLIQTTVCAEPGDSGGPLYSNGGVAYGLTSGGSGDCSSGGTTFFQPVTEALSAYGVHVY

SEQ ID NO: 44148 - protein, 307 aa, Streptomyces sp. e14
MHRAPPGDVRRPHHREPPSTTQHHRARPRTADGASAPAASHAARAPSPRGTPGRPRGIYMSECAYTHADSQPEGARRARTTAVLAGAALLAPLGLLTAAGGAHAADSGVWDRIARCESGGNWHINTGNGYYGGLQFAASTWRAYGGTAYAARADQASRGQQIAVATRVQQAQGWGAWPVCSARAGASGGAPAGSAGGSSSSSSSSSSSSSGSGSAGAGTTYKPHKTRSSYESAHETARRETRNTAPATGTGRSQRGGSHGDYTVRAGDTLSGIAARHGIGWQRLYAANASVIGGDPDLIVPGQRLVL

SEQ ID NO: 44149 - protein, 457 aa, Streptomyces sp. e14
MATGALVLTGLSGTANAGTAPGAAAATATAPAPAQSRAAAPTAAETLRTADTSAAVLRAMQRDLGIDRRQAERRLANEAAAGATAGRLRAALGADFAGAWVHGADSGTLTVATTDPADAAAIRARGAEPAVVPHSLAALDAAKARLDRAAAHRDTSDTPVWYVDVRTNMLVLEAVRPAAARSLLAAAGVDASLAKVVKSAERPRPLYDLRGGDAYYINGNTRCSIGFPITRGTQQGFATAGHCGRAGYPTTGANQVSQGTFQASVFPGNDMAWVAANSSWTATPYVSQNGQNLQVTGSTVATVGASVCRSGSTTGWHCGTVQQLNTSVTYQEGTVSGVTRTSVCAEPGDSGGSFISGSQAQGVTSGGSGDCTSGGTTFFQPINPILSAYGLTLKTTTDDPGPGDPGPGNPGGTWAAGTVYQAGDTVTYGGASYRCLQGHQAQPGWEPPNVPALWQRV

SEQ ID NO: 44150 - protein, 360 aa, Streptomyces sp. e14
MLGLEPSDPLPDLLELGRMLAPDSRRALYQAVHDALLREREIVDLELRMTSPHERILRFIAEPVRPRLGPVWTMRAVCRDVTSDVRSRTLAEQAMQEARAQRERADAVADVAERLRDAIVPRFPAELGRHGVEAAAVYRPEGRAARVGGDWYKTRVLPSGQVLIALGDARGHGLDAITLMAKLRYALAGLAFTGEAVERLTGWLNLVACDDGEESTATAIVARYHPDRALLRWTCAGHPLPILIRDREARLLDPPPSGPGMPLGVWTEEAYTAAETLLHPGDVVLLYSDGLIERRGSDLDRDSSRLVRAVHDSARDGIPPGGEALDAYIRRLVDRLTGPHMQDDATILAFRLVGRDVVGG

SEQ ID NO: 44151 - protein, 803 aa, Streptomyces sp. e14
MAGAPGTATAATPATPATPAASELGAAAEDFASLRATWRTLLLGTGVTPTRAPFAAKLAAIGDTASRYADALSPADGSLWPDAVWADPDPDTDSESYAFSGAIQTSYQRLYAMAEAWSQPGTGVTADPALAAAVVAGLDHMYARIYNERQTRYGNWYSWQIGAPQPLLDTAVLLYDRLSAEQIARYCAAVDAFVPDSSVASYSGTSTGANRIDLCRVLAVRGIVGENAAKVALASSAMSPVFPYVTAGDGLYADGSIIQHTYVPYTGSYGAVLIDGLSRLLALLSGSPWEVTDAGKQVVLDAVEAAYAPFLHNGLAMDGVAGRAVSRGLPPGAAAGQNDDHTRGHAIMASIVALGQAAGPAENARWRALVKGWIQRASYRSPVTDPQLSVAKLALLNEVLDDDSVTAAAQPRDSRIFPAMDRAVHRRTGWVASVSMASKRITYYENGNGENLHGWHTGSGMLYWWGEDFADDQYSDRFWATVDPYRMPGTTVSGKKLADGEGGAWGAARPDVDFVGGAGDGVYSALGQHLKGLSSTLEARKSWFLLEDAVICLGSGITASDGAPVETIVENRHLGADGRNTLTVDGRPLPTALPWSGSAPRARWAHIAGHGGYVFPERPTLRALREERTGAWHDINSMTGLPDRFGSRYATLWLDHGTAPKDAGYAYVLLPGASAAATARRSASLGRWLRACVRTAGVHGVRVPSLGVTGANFWSPGRFEQVSADAPVSVVVRERRDGTAVVCVADPTRLHDEVTVTWHRPVRSVLSRPVTVTGAETGRVLRLTFSGLSATGGVTQRTVVRPA

SEQ ID NO: 44152 - protein, 386 aa, Streptomyces sp. e14
MRQKTVLRAVLSAGLLLTAASVGLTEAAADDASAPSAATGRQAPASDALLTAMQQDLGLTRSQAVDRLAAETKARETERGAERAAGDAYGGSWFDAESGKLVVALTRGGAREAVEATGARVKLVRHSERELDATMRRVDALHAPAGVTGWHVDPEANSVTVDVVAAHQDDNDVKAFVARALKAGPVTVNKTGKAPRTLAAGTVGGDPYYTGNVRCSIGFSVYGGFVTAGHCATPGAAVNGWDGSYIGNFQGSSFPDNDYAWVNVGSGWWTVPVVLGWGTVSDQLVRGSAEAPIGASICRSGSTSHWHCGTVLAKNETVNYSQGAVHQMTKTNVCAEPGDSGGSFISGDQAQGVTSGGWGNCSSGGETWYQPINEILSRYGLTLHTA

SEQ ID NO: 44153 - protein, 488 aa, Streptomyces sp. e14
MRWHTLREFGRRAARAAALGALAAGLVTLAPAAQAEAAGTLQQVTNFGSNPGNLAMYEYAPANLPANAPLVVALHGCTQSASDYHSHSGWQKFADQWGFAVVYPQTGAANNSLSCFSWFDATKDTRGKGEAASVVQMVDHAVAQYGSDRSRVFVTGLSAGGGMTADLLADYPDVFAGGAVDSGLPAQCATTQAAASGCQYSGQNLTPKQWGDKVRASYPGYTGPWPRVAIWQGSSDTTVAPVNGTELRDQWTDVWGIGQTPSATRTLTGNTTETTYNGSSGTAAVALFSVSGMAHGLAVDPGSGADQCGTTGAYYLDTICSSYHTAKFWGLDRSDGGGSGTLPAPSAVTVTATTDTTAALAWNAVDGAASYAVYRDGAKVGAPAGTTYTDTGLSAGTTYTYTVAAVDGTGATGAASAPVTATTTGATPAPKCYTDNNYNQVKAGRAHQSGGYTYANGSNQNMGLYNVAITHTLKETSPAYFVIADSGC

SEQ ID NO: 44154 - protein, 715 aa, Streptomyces sp. e14
MAPATGSLWPDQPWTSSSSGDQVTASYERLKTMALAYSRPGTGLTGDSSLATAIATGLDHIHAQVYNTTYTAGSGWWWNTQIGAAHALLDVCVLMYDRLTADRIAAYCASVDHFLPDSRVSSYTGQSTGANRVDFCRTYALRGVVGKNSAKIALGRDALSPVFPFVAAGDGFHTDGSFIQHTYVPYTGSYGSVLLGGLAWLFALLKGSAWEITDPGRQLILDSVERSFAPFVYNGLLMDGVCGRAVSRGLSAGATYPSNDHTRAHGLMASILLLGLGASASEQARWKAMVKGWLDRDAYVPLPTDQFLDVPSLGRLASLQDDSTVTAAAEPVEHRLFPKMARAVHRRPAWAASLSMSASDITFYENGNGENLRAWHTGNGMLYWWGGTYGLGQYSDAFWPTVDPYRLPGATVSRKTLSDGEGGQWGVARPSSTWVGGATDGEFAAVGMDVRGLSSTLVGRKSWFFVDDAVICLGGGIRCTDGTGVESIVDNRNLGASGSHALTVDGVAQSSALGWNATFPRASWATIAGFGGYVFPGGASVKALREERTGSWHDINTLSGSTTPLTRRYLTLWFDHGTDPAAGSYAYVLLPGADPATTAARAAAAGWLTVLANTVNQQGVSVPSLGLTAVNFYGGGTVGKVSATAGVSVMIRESGSTATICVADPTRQRTTVDVTWNRPVGQVTAKDPSVTVLGTGTSVSLRIDQRRQGRSHPEG

SEQ ID NO: 44155 - protein, 161 aa, Streptomyces sp. e14
MVQSVAKRQAAQPNLKSVTVYYNASQAPSFRSQISSAASIWNSSVSNVKLQATSGSADFAYYEGNDSRGSYASTNGHGSGYIFLDYAQNQQYDSIRVAAHETGHVLGLPDHYSGPCSELMSGGGPGPSCTNRYPNATERSRVNQLWANGLAQAVAKLAQAR

SEQ ID NO: 44156 - protein, 326 aa, Streptomyces sp. enrichment culture clone 1 MDM-2011
MPHTALRRLSGVTLSAALAAVTLAVNTPQATAAETPSLRVLTYNAFIFSKTLYPNWGQDHRAAEIPKTSFFRGNDVVVLQEAFDNSASDALLRNASAQYPYQTPVVGRSKSGWDATGGSYSATTPEDGGVSVLSKWPIVRKEQYVFKDACGSDWWSNKGFAYAQLNVNGTPVHIVGTHAQSTDPGCSAGEAAQMRSRQFKAIDTFLDAKEIPASEQVIVAGDFNVDFHSSEYASLLSDAGLTAADARTGHPYSFDTRDNSIASERYPDDPREDLDHVLHRAGHAKPSGWTNDVVKEQSAPWTVSSWGTDYTYTNLSDHYPVIASGR

SEQ ID NO: 44157 - protein, 298 aa, Streptomyces sp. J-13-3
MFRRIMGLLAALGAVVAGLVVLPATTASAADCAAAWNASSVYTGGGSASYNGHNWTAKWWTQNETPGSSDVWADQGACGNGGGTDPGDPGSSFGFVVSEAQFNQMFPGRSSFYTYSGLVAALDAYPGFANTGSDTVKKQEAAAFLANVSHETGGLVYIVEQNTANYPHYCDSSQPYGCPAGQAAYYGRGPIQLSWNFNYKAAGDALGIDLLGNPYLVEQDAAVAWKTGLWYWNTQNGPGSMTAHNAMVNGAGFGETIRSINGSIECNGGNPAQVQSRIDKYQAFVQILGTTPGSNLSC

SEQ ID NO: 44158 - protein, 316 aa, Streptomyces sp. LZ35
MRTARRTRRRGRLTAAVSGLFITAALATVGTSAAASSAMTATSAPSATATPSSVSTPVSGAASSVSGAASAVASLDVPGTAWTVDERTGTLRVLVGSTAREADLARLDRTAERFGGTITVERLDGPLRTLLSGGDGIHSTTGLRCSAGVNVQSGTTYYFVTAGHCTDAAPTWYTGSDATTPVGSTTATSFPGNDYGVVRYTNTAVPHPGTVGTVDITGTATAYVGQQVCRRGATTGVRCGQVIALNATVNYGGGDVVSGLIQTNICAEPGDSGGPLYAGDKIIGILSGGSGDCATGGTTFYQPIQEVLSAYGLTVY

SEQ ID NO: 44159 - protein, 158 aa, Streptomyces sp. Mg1
MPLEVCRSVLCCGSGPEGVVRGPARCSWQARPYSEGGLMSRQRKDRRSRSVIGQLLASAGLLTVVLLNASGADAAAVHSKPDRVWDAIARCESGGNWRANTGNGHYGGLQFTQSSWKAAGGRKYAPRADLATKAEQIATARRLAEIQGMGAWTCARRH

SEQ ID NO: 44160 - protein, 399 aa, Streptomyces sp. Mg1
MSATPRTKRRVNKKTTALATTALTVAGLGAALLATIPANAASVGTWDKVAHCESTDDWQINTGNGYYGGLQISPQTWNAFGGREYAAYPHQATKQQQILIGEKILAGQGQGAWPNCGPAAGLGSDHADPYPATSTPPAPVGMVHLTAADFTGDGKKDLVGVESASGKLWLYPGNGNGTLGNRVQIGSGWNGMSNLTAADYTGDGKADLVTVDNSTGKLFVYPGAGSLNGSATLGARVQIGSGWGTMRNLTAIDVNKDNKADLLAVDPAGALFAYPGTGTGTLGARTQIGSGWGSMAELASPGDLNSDGKDDLVAVDPAGNLWKYPSTGSLNGTNTLGARNQIGSGWDTMHQLVGADFNGDGKGDLDAVQAPTGSTGTFYFYPGNGSGGFADRAQIGTGW

SEQ ID NO: 44161 - protein, 427 aa, Streptomyces sp. Mg1
MSSLGAPMGVRGRHRRYQPSSINRASLAVTAGGAGIALPLIGAGVAHGASVDTWNKVAACESTHNWHINSGNGYYGGLQFSQSTWREFGGTAYAARADLATKDQQIAVAEKVLKGQGPQAWPACGKQAGLSRGGPAPAAIPQQKQAQQPAALRTEAEQATAEQRQNAPRPTGTSVLPNPYVVAPGDSLSAIATEQHVEGGWQALYETNRATIGGNPNLILPGQRLTLRITAAPPAQNPEKPPRTAEPVKPGEPAAAKPKPEQAKPAPAKPAPAKPAPAKPAPQPASAQQQPAAGVFSAPVDAGLGTAYRVAGSSWSSGYHTGVDFPVPTGTTVKSVGSGQIVSAGWAGAYGYQVVIRHSDGRYSQYAHLSALSVKAGQQVSGGQRIGRSGSTGNTTGPHLHFEMRTGPGYGTDIDPLAYLRGRGVRI

SEQ ID NO: 44162 - protein, 222 aa, Streptomyces sp. Mg1
MRHSRTSRTAVLAATLGLGLATAVVGVAPTASAAPAPVGNAASYAAYERSQENESANAAFFDAVRRSVAEQRAANPGIRAVTVTYNTRNAPSFRSQIARSTQIWNSSVSNVKLQEVSSGGNFSYYEGNDSRGSYASTDGHGRGYIFLDYQQNQQYNSTRVTAHETGHVLGLPDHYSGPCSELMSGGGPGTSCQNPNPNAAERSRVNQLWANGLVGSGLGSKG

SEQ ID NO: 44163 - protein, 364 aa, Streptomyces sp. Mg1
MRSGNGRHRRPRQVPAIVVTAGVTGSALALPLLAATNASAADASTWDQVAECESGGSWSANAGTGAYGGLQFSQEEWKNAGGLSYAERADLASRSQQIAVAERVLASQGPEAWPLCASPAGLTKDGPSADVNPGNAGSVAPSPSRPDSSVPVQGSTQSKDYGAPTPVPAPAGSPTFGLPDIPQGPSLGLPVMPDPDLPSTTPSAPTTPTTPGGSTTDPASPTTPGTPTAPGTPTTPADPSTSPSAPSGSTNPGNPTIPAAPGTPGATTGPGASPTPSATADDAAGAAGEGAGKHRGPAAVENASAPDAASDPTYTVKAGDSLATIATAKGVKGGWNALYQANEQVIGGDADLIKPGQNLDLSKK

SEQ ID NO: 44164 - protein, 245 aa, Streptomyces sp. Mg1
MLSGKSKGKHRRGSKAVRIVTLAGVAGVAVAAPLMAVGSASAATASEWDRVASCESGGNWSINTGNGYYGGLQFSSSTWASYGGTAYASTANKASKSQQIAIAEKVLKGQGKGAWPVCGKGLSGSSYNGGTEAAKPKPKPEAKQQQKAAPKKETKRAEAPVTRSERAQAPAPVKTAPKTEQKAAPAAPKAPKTGNGSYEVKQGDTLGTIAEANGVQGGWEKLFELNNDVVSDADLIFPGQKLDLS

SEQ ID NO: 44165 - protein, 426 aa, Streptomyces sp. Mg1
MPSIDVVVAREILDSRGNPTVEVEVGLDDGSTGRAAVPSGASTGAFEAIELRDGDPNRYFGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLHTKGLSTGLGDEGGFAPNLESNRAALDLIVEAIKQAGYVPGKDIALALDVAASEFYKDGKYEFEGQSRSAAEMTEYYEELVSAYPMVSIEDPLYEDDWAGWKTLTDKLGTKVQIVGDDLFVTNPERLARGIEEGSANALLVKVNQIGSLTETLDAVEMAQRNGFKCMMSHRSGETEDVTIADLAVAVNCGQIKTGAPARSDRVAKYNQLLRIEEILDDAAVYAGRSAFPRFKG

SEQ ID NO: 44166 - protein, 387 aa, Streptomyces sp. Mg1
RRRSPGDGAPRTGRRRRAAAPVAARDSWRRLVPQALVVAFLAGGTTAFVAADKSVRLTVDGVPRTVRTFAGDVDALLAAEGLGVGPHDLLAPARDASLDDGDEIVVRYGRPLRLTLDGSRRQVWTTARTIDGALRQLGVRAEGAYLSAPRTAPVPRDGLTLSVRTERSVTFMADGRERTIRTNAATVQEALDQAGVTLHDQDTTSVPPGSFPRDGQTVTVLRISGTREVREERIPYETQRIDDATLFAGTEVVEQAGRPGARRVTYSLRTVNGVHEKARRIAEETVREPVTQRVLVGTRTLPASVAGADGLDWAALAQCESGGRPDATDPSGTYGGLYQFDVRTWQALGGSGRPQDAPGQEQTYRAKKLYVQRGATPWPHCGRRLYR

SEQ ID NO: 44167 - protein, 627 aa, Streptomyces sp. Mg1
MRELRAQGAPAFESAPSAAPLPDSFYIAQAKDYVRSVSEAIGFAAEEPAEFEADPSVTATSAGVRVVSLQQMLGGIEVWGMAPKVWLLEDGTVDRVVGDTVSVPPDLPVTPVVSAETALRVAAAKAAAPSTITGPFGSDELPALDVSGGFERLSVQPENNRPVTFAKGPFAEAVPARLVYLYMGGETRLAWFFTFSREHLLVQYHAFVEADARTADPAAPEILYFYDATNHAIAGTVFRHNPMEGDLAQVTFPPPLTDYPTLVPDTLPPGFPDAWTRPANGTVATEGNNVRASSGEDALPFEVGVGAGGDGVFDPLVNTPEHLVTNIFYFCNYMHDFFMMLGFTEEFGNFQTVNPTGLGKGADPVLAFAHPGPVPGTANMATRADGVAAEMNMGLVARSGRHTANDGDVVYHEFCHGVTNRLVGGMADANGLREKQSTSMGEGWGDYFALTIINFSRPEERVVLGNWVVDSPKGIRQRPYDSRYPGRFGDIGRARGEVPGDGRADLDYAEIHNVGEIWCAALMELTRSTSAALGNKERGYRLTWQAVVDGLKLTPRNPSFLTARDAVLAAFKAMKGRALTDEEYKVVRTGAWAAFARFGMGFDAFSPNASFAGCRSGTAMPPAGSED

SEQ ID NO: 44168 - protein, 225 aa, Streptomyces sp. Mg1
MPDLRFRLRPRPHRVRRAVSAAALALVLPWTVAEPSAASAPPPPAPGPAAAHPGSPGVIGTGPGDCGPGGEWPWDCVADCESSGRWSVNTGNGFYGGLQFWQRTWEEHGGLAFAPRADLATRAQQIAVAEELLGTQGWEAWPVCSKRYGLAGRMHVVRAGDSLDSIARRRRVRGGWWALYEMNRPVVGPRPQALTAGTLLTLPPADDPARPAPVPAPVPAPVPAP

SEQ ID NO: 44169 - protein, 109 aa, Streptomyces sp. Mg1
MYAPSALVLGITAGEDAASGTVLRAVTLVCAPRPGGTHPSPAAACAELRANSDRLDAVAKPGRGAACTREWNPVTVTADGVWQGHRMSYSYTFGNPCGLRNTTGALFGF

SEQ ID NO: 44170 - protein, 281 aa, Streptomyces sp. Mg1
MAFGALLGTALLAAPVAAHAGAAATIPATAPAAAHAAPAAPAAAAATGLDDPAKKEIAMQIVSSAENSSLDWKAQYKYIEDIGDQRGYTAGIIGFCSGTGDMLDLVEYYTQVKPGNVLAKYLPALRKVNGSDSHAGLDPDFTKDWAKAAQDGEFKKAQDHERDRVYFNPSVKQGKSDGVGTLGQFMYYDAIVMHGDGTDSTSFRNIRKRALSKAKPPAQGGNETTWLNAFLDARVWAMKQEEAHSDTSRVDTAQRVFLKKGNLNLNAPLDWKVYGDSFHIG

SEQ ID NO: 44171 - protein, 796 aa, Streptomyces sp. Mg1
MSQHRAVRTSLLSAAVAVTLLASAGQAVTQAAENGAPVPATFAAAAPAAGPAAPVGNPFDEVDRLGRAKEAVPAPAPAPGGKAVTDAKVPGAATAAAAPAERSEKSRKAAAAAPTARSVAAGVPCTLDGITNLSPEQFADFLGDQAVLADGCLRGLIWTWDARLAPVMSDAHVQAVSRRISSLAAAHDGRGSSHLEEMFTYLHAVAYHDYSRGEIDVTDAPTVDAMRRAIADFGDAARTFDATASNARTLREALYAASAPGLRQHQLGLIKKVLATLDASHPATSQDAAWGGAALAALSVNYLGVYPGNQDAAFHAAVAGDASYRAAFKAFAGHTHLKGTTNAWAVRDALGEYGRFGQVDALKDQTVADLGALLEQVKSGFGNGSEPWAKIVSWLNFYEACKPYGVCKEDIEKQLFPYTYSYDNGAIKVRTALDQATVDQLYYASKQVKAQYHRVLGTEQPLAGDPNTTLNIVLYASRADYENYHPILTGYGTNNGGIYIENGATFYTYQRRVPQDSSLTLEELFRHEYTHYLNGRYAVPGFFGEGPWYEGDRTTAMDEGTAEFFDGSTRDNGIAVRKSLVRGIISDTSGGGPRMTVEQLLNATYDGDGFRFYNYAGTFFEFLWTEKPSLLREMYGYLRTNDVAGYDAWRHRTGADSYLQRDYNRFLDAQIAKVDQLYVPNTTFTPDARLRDSALASVKSSFAAATYNTPDCVENGSAGKRRFVCTGRITANLKNWRSDDQNFKDMSETVDYFILDRAGAVSNNLADMNCSFGPVEIWDTRKAGTSSYSCDGPLRG

SEQ ID NO: 44172 - protein, 334 aa, Streptomyces sp. Mg1
METSCRSTRTDATGPPPRPSRPIAAGALAVTTAPAATAAESAAATPRLSVLSYNVFLMSKSLYPNWGQDHRATEIPKASFYQGHDVVVLQEAFDNGASDALKANSAAQYPYQTPVVGRSKSGWDATGGSYSATTPEDGGVTVLSKWPIVRKEQVVYKDACGADWWSNKGFAYVVLNVNGARVHVVGTHAQSTDPGCGAGEAAQMRARQFKAIDAFLDGKNIPASEQVIVAGDMNVDSRTPEYASMLANADLAGSDTRTGHPYSFDTALNSIANYRYPTDPREDLDYVLYRKGNARPANWENNVVKEQSAPWTVSSWGTSYTYTNLSDHYPLIGR

SEQ ID NO: 44173 - protein, 298 aa, Streptomyces sp. Mg1
MRIKRITRTRLLAVATGLAAAAALAAPTAASADGPRDGQDPGFSAARLASAGASVLRADVGGTAWHTDPATGTLVVSADSTVSEASLAKIRREAGADAAALRIERIPGKLTKLVSGGDAIYATSWRCSLGFNVRSGSTYYALTAGHCTDGAGTWWSDSARTAVVGSTVGSSFPTNDYGLVKYASNTPVPPGTVGSQDITSAVDPTLNMSVSRRGSTTGIHSGTVTGLNATVNYGGGDIVYGMIRTNVCAEPGDSGGPLYSGARAVGLTSGGSGNCSSGGTTFFQPVVEALSAYGVSVY

SEQ ID NO: 44174 - protein, 572 aa, Streptomyces sp. Mg1
MHIRKPLIAAAATVALAAGALASFAGLGTAAAAGSSTTATAATPGGVRIAYYDQWSVYGNAFYPKHLDTRGIAGKLDVINYSFGNIHPTNLTCFEANKAAGDDNNPNAGDGAGDSYADYQKSFGAADSVSGVADKWDQPIVGVFNQFKQLKAKYPHLKINISIGGWTYSKYFSDAAKTDASRKKLVSSCIDQYIKGNLPVEGGFGGAGTAAGIFDGIDIDWEYPGSAGGHLGNHYAPEDKQNFTLLLKEFREQLDAYGAANGGKKYLLTAALPAGQDKIKYIETDKIGSYLDYANIMTYDMHGAWDGDGPTYHQSPLDNSAADPTDPIAPGTQKYGVKNAIDSWIDGNPAYGIAGGFPAGKLTLGYEFYYRGWKGVPAGTTHGLAQTATGPSAARPTSQQAGIANYKELGGIVDNPATTFWDDQAKASYFYKDGEFFTGLNQKSVQARVDYGKQRGLAGAMMYSLLGLDNNTTLLNQISDALGGTTLPPTTPPTTPPTTPPTTPPTTPPTTPPTTPPTTGCGSVAAYVAGTVYTGGQEVSHNGHKWKAQWWTQNEAPGTTGEWGVWKDLGAC

SEQ ID NO: 44175 - protein, 303 aa, Streptomyces sp. MG3
MYRRVMSLLAALGAVVAMVVALPASASASAFTTAVAADCAAAWNSSSVYTGGQSASHNGHNWTAKWWTQNETPGSSDVWADQGACGGGGTDPDPGNPSGFVVSEAQFNQMFPNRNPFYTYNGLTAALSAYPAFANTGSDTVKRQEAAAFLANVSHETGGLVYVVEQNTSNYPHYCDSSQPYGCPAGQAAYYGRGPIQLSWNFNYKAAGDALGIDLLGNPYLVEQDASVAWKTGLWYWNTQNGPGTMTAHAAMVNGAGFGETIRSINGSLECNGGNPAQVQSRIDRYKSLTQILGTTPGPNLSC

SEQ ID NO: 44176 - protein, 785 aa, Streptomyces sp. SirexAA-E
MLSPTRARPTLPAAVAAVAGLLLGALAVIPSTAAATPSAATADQESCRPDGLYRTPGVDVPYCSVYDTEGREKMGADHQRRVIGYFTSWRTGKDGKDAYLASDIPWDKVTHLNYAFAHVDGDNKISVGSDGPRNASTGMTWPGVAGAEMDPALPYKGHFNLLSKFKKQHPDVKTLVSVGGWAETGGYFDDNGDRVDSGGFYSMATNADGSVNQKGIDTFADSTVAFIKKYGFNGVDIDYEYPTTMKDAGNPLDHTLANARRAGLVKGYGALMKTLREKLDRASAADGTHYLLTVAAPSSGYLLRGMETFQVQKYLDYVNIMSYDLHGAWNEYVGPNASLFDDGKDAELAQAGVYSTSQYGGVGYLNTDWAYHYFRGSMPAGRINIGLPYYTRGFKNVQGGTDGLWGKAATTDCPAGAGLTKCGDGAVGIDNLWHDLDANGKESPAGSNPMWHAKNLEKGIVGDYVTQYGFPADTTLTGTYTRKYDSTLVAPWLWNAQKKVFLSTEDEQSVAAKADYVVDKGIGGTMIWELAGDYGWDAAKGQYEQGSTLTSAMYEKFKAASPYGATRSTIDLPAQALDIDVSFEQFALGDSNYPIGPKLRITNNTTATLPGGTEFRFDYATSAPANAKDQSGFGTTVVRSDHTAAGNVGGLKGDYNRVSLKLPAWQTLAPGASVRLDFVYYLPTSTPSNWTVAFDGSTYALAGDLARGTTVVQPGAGPGTGPGTSPSPDPGGGTCSPAAWSATAEYGTGATVSHGSHTWKAKWWTKGETPGSTGEWGVWQDLGAC

SEQ ID NO: 44177 - protein, 361 aa, Streptomyces sp. SirexAA-E
MSHRRISRKRAALAGSAVVALVVTGVSFQTANASDDVPQFTARTLTAQAAGNLATTLDKTLGADAAGAYYDAEAKHLVVNVLDEAAAEQVRQAGGTARIVQNSVAELKAARQTLADRATVPGTSWAVDPVSNKVVVTADRTVDSASWDKLGAVVKGLGGKAQLNRTAGEFKPLIAGGDAIWGNGGRCSLGFNVVKDGEPYFLTAGHCTDAITSWSETQTGAEIGANEDSSFPDNDYGLVKYTSGTAHPSEVDLYNGSTQKITKAGEATVGMTVTRSGSTTQVHDGEVTALDATVNYGNGDIVNGLIQTTVCAEPGDSGGSLFAGDTAIGLTSGGSGDCSAGGTTFFQPVPEALAAYGAEIG

SEQ ID NO: 44178 - protein, 304 aa, Streptomyces sp. SirexAA-E
MRIKRTTTPRNGKSRRTRTAAVVAAAVAGLAAVTAQAAPAAGAGTAETYSADQLAAAGQAVLDADVAGTAWHLDPVGERLVVTVDSTVPQTGIDRIKRTAGAQAGALRIERTPGKLRELISGGDPVYTDGWRCSLGFNVRNGDTYYFLTAGHCTEGAGTWYADPGKTVVLGTTYGSSFPGDDYGIVRYTNDSVPKEGTVGSQDITGAAAATVGMPVTRRGSTTGIHNGTVTGLNATVNYGNGDIVQGLIRTNVCAEPGDSGGPLHSGPRAIGLTSGGSGDCTTGGTTFFQPVTEALNAYGVSVY

SEQ ID NO: 44179 - protein, 192 aa, Streptomyces sp. SirexAA-E
MLDSRWFKAAGVTAAMTLATVTAAHAVPAPEPAAESSAAAVTLRYDDSRAVGWEAAIAAGVASWNANVSNVKLVEAAPGTRAEIQIVATSGWPQATLGPVRPGGQARVELGSQAVAEGHDKTRIAAHELGHSLGLPDTKPGPCSQLMSGSSAGTSCTNAVPNAAERSRVQSAYAGGLVSRAPADGRVLVDAP

SEQ ID NO: 44180 - protein, 253 aa, Streptomyces sp. SirexAA-E
MPASPLAKQPVEAVFALLLVLLSVLGLAGRSVAATPAQAAPAQAAPARAALVHTVTAGTDWDRIAQCESGGRWDINTGNGYHGGLQFAPSTWQAYGGKQYAPRADLATRSQQIAVGERVARSQGMGAWPNCGRLGAGGTSNSGSGTQAAPGKQSGGGVNGTSGSAGSVSPASGSASSASGSRADDSSDHATTTRSHDLVGKETHVVEPGDCLSVIAERAEVPGGTDALYELNRALLDKGPDLIYPGQRLRLIA

SEQ ID NO: 44181 - protein, 428 aa, Streptomyces sp. SirexAA-E
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATENKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLILEAVKEAGYVPGRDIALALDVAASEFYKDGVYEFEGKSRSAAEMTEYYEELVSAYPLVSIEDPLYEDDWAGWKVITDKLGSKVQIVGDDLFVTNPERLSRGIEEGSANALLVKVNQIGSLTETLDAVELAQRNGFKCMMSHRSGETEDVTIADLAVAVNCGQIKTGAPARSDRVAKYNQLLRIEEILDDAAVYAGRSAFPRFRHEG

SEQ ID NO: 44182 - protein, 238 aa, Streptomyces sp. SirexAA-E
MLLSSKGKHRRPSKAVRVATLAGVAGAAVVVPLMGATGASAASVSTWDAVAQCESGGNWSINTGNGYYGGLQFSQSSWAAAGGTQYASRADLATKEQQIATAEKLLALQGPGAWACAGAGGLTNDGVDPGVDTGSNSGSASSSAKNGDSAPQAQPERKAEQPTTRSEKRTAPKETVTTPTGGKVEKGDGEYKVKTGDTLSKIADAKNVKGGWQKLFELNDDIVDNADLIFPGQQLHLK

SEQ ID NO: 44183 - protein, 342 aa, Streptomyces sp. SirexAA-E
MGSANGRHRRPRQAPAIVVTAGVTGSAIAIPLLGATGAHAADASTWDRVAECESGGMWSADLGNGSYGGLQFSQDTWMDFGGTAYAPRADLASRSQQIAVAEKVLDAKGPQAWPSCAVISGLVVDGALPGVDPGGDTATEETATPSPEATDGASDEASDGSEGKAKDKATDEPSDDATGSTDKGGTDASDGADGSTGRENSAPSASPSTTTPSPEATGTPGTSQGTPGGKHRGAPAPEAGTPGSEETGGREAGRHASRGDSGAREGAGTAADGSYTVQEGDNLWAIAEAQELPGGWTALYAANKEEVGSDPDLILPGQSLDLTPAADAGDASAQDGAATTGS

SEQ ID NO: 44184 - protein, 273 aa, Streptomyces sp. SirexAA-E
MSQYTQPPQPHSQPPYAPAHAPGTRPARNGLGIAALVLGIIGSVSGLIPLLFWLAGVLGLIALILGLSGRGRVKRGEATNKGVATFGAVLGLVALILSVVGAVITFKAVDDVVKDIDKEISGSSASAKPGGTGDGGTSGDAPEGEALTEGDTAVYDDGLEVTVNAPAAYTAGEFAIGHTKGNDAYTVSVVIENKGKEKFDAALVTLEARAGKDGVDAEQIFDDKIGEGFTGTVLPGRKITAEYAFDAPADAGNLTVEVSSGFDRDTSHWDLKL

SEQ ID NO: 44185 - protein, 291 aa, Streptomyces sp. SirexAA-E
MTERSAVPPEEPGGSPRTDPRLTARGGRPISRKSLLRAAVAASAVPLVAGGGAALARDTGAGAVPLAPTPACDDGDDPTPDQMEGPYFKPDSPPRTSLVTSSTPGVPLTVSGYVFGRACKPLTGVLLDFWQADTGGAYDMTGFAFRGHQFTGADGSFTLRTIVPGLYPGRTRHIHVKAQAPGRPVLTTQLYFPGEPRNTTDALFDPALLMNVRSAGPGREGTFDFVLDVAQQPDPTDPPTDPPGGGGWAAGTTYRAGDRVTYGGGSYRCLQAHTAVAGWEPPLVPALWERG

SEQ ID NO: 44186 - protein, 449 aa, Streptomyces sp. SirexAA-E
MLRRRALVAATAAVAVGALGLAGLSGVASADPQGATAPAADRLSPGLLEAMRRDLGLGADEAKARIADEYRAAAVARGLEKSLGADFAGARVSGPEAVLTVATTDRADVAEITAAGARAEVVGHSLGRLDAAKAALDAVALKKAPKDVPSWYVDVRTNRLVVNAARTAAADRLLDAAGVSRALVRVVHSTEQPRTYADLRGGDAYYMNGSGRCSIGFPVKRGTQNGFVSAGHCGTPGVTTSGVNQQAQGSFQGSTFPGRDYSWVAVNANWTPRALVNGYGNGDVTVAGSTQAVVGSSVCRSGSTTGWHCGTIQQHDTSVTYQEGTVSGVTRTGVCAEPGDSGGSFISGSQAQGVTSGGSGNCSQGGTTYYQPINPALSAYGLTLVTSGTPTDPPTGPPTGEPGGTWAVGTTYAAGAVVTYGGASYRCLQGHQAQAGWTPPDVPALWQRI

SEQ ID NO: 44187 - protein, 69 aa, Streptomyces sp. SirexAA-E
MQGTPDEPGTPGAEVPGADVPGTPEEADGPGTDVPEAPEETDDPDPDVPGTPEEADGPDEAGTAGGPRP

SEQ ID NO: 44188 - protein, 301 aa, Streptomyces sp. SirexAA-E
MPVKPVTRLVLFGAPIAIAASILFSRGDSEPPKLTPQAAAPAPSDQEEPEAVARAEEHAEEIDALPPGLAAPEMKEIASRLVSSADASTLDWRSRYGAVEDLGDGNGYTAGIVGFCSGTNDMLQLVEAYTEEQPDNPLAPYLPALREVDGSDSHEGLDPGFTRAWREAAEDETFRSAQDRLRDRLYFDPAVRLAKLDGLGTLGQFVYYDAMVLHGPGVEANGFYGIRDAAMAQADTAAEGGDETAYLDAFLDAGRTAIRARTVQRDTSRIDTAQRVFLRDGNLELRTPLVWRMYGEDFRIP

SEQ ID NO: 44189 - protein, 280 aa, Streptomyces sp. SirexAA-E
MSERAASPRTHRRRPGRRRIATALTAALGLTGAALATGVMLQPAGAATTAIPAWPSATGSQSVSKTIEVSGTYDGGLKRFTGSGDLGDGGQDEGQDPIFKLKDGATIKNVILGTPAADGIHCSGSCTIQNVWWEDVGEDAASFKGTSTSSVYTVYGGGAKKASDKVFQFNGAGKLVVTKFQVADFGKLVRSCGNCSKQYKREIIVNDVDVTAPGKSLVGINTNYGDTAALRSVRVHGDSSKKIKPCVRYTGNSTGAEPKETGSGPDGTYCKYTASDLSYD

SEQ ID NO: 44190 - protein, 295 aa, Streptomyces sp. SirexAA-E
MIRRVMGLLTALAAVVATLVFLPAATASAATCAPAWNASSVYTGGGSASYNGHNWSAKWWTQNERPGTSDVWADQGACGSGGGGTDPNPSGFVVSEAQFNQMFPSRNSFYTYSGLTAALSAYPAFANTGSDTVKKQEAAAFLANVSHETGGLVHIVEQNTANYPHYCDTSQSYGCPAGQAAYYGRGPIQLSWNFNYKAAGDALGIDLLGNPWQVEQNASVAWKTGLWYWNTQSGPGTMTPHNAIVNGSGFGETIRSINGSIECNGGNPGQVQSRVNTYQSFVQILGTTPGSNLSC

SEQ ID NO: 44191 - protein, 295 aa, Streptomyces sp. SirexAA-E
MKRIKRFLTVLSAVVATAAFLPGAAGAAAAAPSGEASPCAPLWSATTAYPAGGTVSHHGRNWSATWWTRNENPGATTVWADRGACTGGVSDFAVSEAQFDAIFPERDPFYTYQGLIDALHAYPRFANTGTPQTRAREAAAFLTHADFESVGLRYVKEINEANYGRKCDDTQPYGCPAGREAYYGRGPIMFSWNFNYKAAGDALGLDLLNDPWLVERDPSVAWQTALWYWNTQNGPGAMTSHDAMVGGAGFGETIRSLNGALECDGGNPESVASRVARYERITGIVGTAPGSGLTC

SEQ ID NO: 44192 - protein, 221 aa, Streptomyces sp. SirexAA-E
MRHPRTVLMSAVAGLGLAVALGASPAAATAPAHSAPSTSTTNGYAAYAGSSENAAANQAFFEAVMKSVAEKRAAVPGAQAVTVVYSAAQAPSFRSQIASSASIWNSSVGNVKLQEGSNADFVYYEGNDARGSYASTDGHGRGYVFLDYAQNQQYDSTRVTTHETGHVLGLPDHYSGPCSELMSGGGPGPSCTNAYPDATERSRVNSLWQNGIAAALARAGS

SEQ ID NO: 44193 - protein, 302 aa, Streptomyces sp. SirexAA-E
MTFKPLGSLSRRARLIAVTSGLVTAVALAAPTAVAQPTQDTAVTKAALADASTAVRGADIAGTAWYTDAKTGKVVVTVDSTVSATEVATIEKSVTDTGAKIDIKHTPGTFNKLIAGGQAIYAGGGRCSLGFNVRSGSTYYALTAGHCTEIGSTWYTNSAGTASLGSRAGSSFPGNDYGLIRHSNSANADGRVYLYNGSYQDITSAANPTVGQAVKRSGSTTGVHSGTVTGLNATVNYGGGDIVSGLIQTNVCAEPGDSGGSLFAGSTALGLTSGGSGNCSSGGTTFFQPVVEALNAYGVQVF

SEQ ID NO: 44194 - protein, 507 aa, Streptomyces sp. SirexAA-E
MRRSRSVRALVTAAVTTVAAAGMAVLGSGTAQAATPLPDHVFAPYFESWTGESPAAMAAESGAKHLTMAFLQTTAKGSCTPYWNGDTGLPIAQASFGADIDTIQAGGGDVIPSFGGYTADTTGTEIADSCTDVDQIAAAYQKVVTTYDVSRLDMDIEVDSLDDTAGIDRRNKAIKKLQDWADANGRDLEISYTLPTTTRGLASSGLAVLRNAVTNGARVDVVNLMTFDYYDNASHDMAADTETAAQGLYDQLAKLYPGRTATQLWSMVGVTEMPGVDDFGPAETFTLANAARVYDWAVAKGINTLSFWALQRDNGGCPGGPAADDCSGIQQNTWDFTRVFAPFTSGTTAPDDDFSVTATPASGTVTAGGSATTTVKTAVTKGAAQQVGLTVSGVPAGVTASLSPSSVTAGGRSTLTLATTQAAVSGTYRISVTGTSPSGSHATAYTLTVTGGTGSQCTAGPWAGGTVYTGGQQVSYKGHTWKAKWWTTGEEPGTTGEWGVWQDLGAC

SEQ ID NO: 44195 - protein, 289 aa, Streptomyces sp. SirexAA-E
MLHPHNRTARRTTRLTRTGGLAAAALGLALMALPVTAHAGAPTQPAAHHLEAAATGLDDPAKKDIAMQLVSSAENSTLDWKAQYGYIEDIGDGRGYTAGIIGFCSGTGDMLALVERYTDRSPGNVLASYLPALREVDGTDSHDGLDPGFPRDWAEAAKDPVFQQAQNDERDRVYFDPAVRQAKDDGLGTLGQFAYYDAIVMHGGGGDSTSFGSIRQRALAEAEPPSRGGDEVAYLDAFLDARVWAMRQEEAHSDTSRVDTAQRVFLRDGNLNLDPPLDWQVYGDSFHIG

SEQ ID NO: 44196 - protein, 265 aa, Streptomyces sp. SirexAA-E
MKTKLLALAAALALTGCSGPGPDAPEKGLADPAKKDIAMRLVSSAENSTLDWKAQYGYIEDIGDGRGYTAGVIGFCSGTGDMLKVVERYTAARPGNALERFLPALRAVVGGDSHEGLGDAFTEAWARVADDTAFRRAQDAERDETYFDPAVARAEADGLSALGQFVYYDAFVMHGYADAKGTVGFRTIRAEAVEAADPPSRGGDEEAYLDAFLDARVRAIRQEPSHSDASRVETAQRVFVHEGRLQLETPLVWKVYGESFRIDGP

SEQ ID NO: 44197 - protein, 378 aa, Streptomyces sp. SirexAA-E
MVRTGLSALLIIGTWATAGLTQASAADPSTTATEAPASAGLLTAMQKDLGLTKTEAEARLTAEKSATALESTARKAAGASFGGAWFDAGSGKLTVAVTDDASARSVRATGAQTRLVTHTARQLDAAKARIDALTAPRGVSSWYVDPQANSVVVNVVAPERDDNDVRAFLAKARQTGPVTVRQTAQAPRTFAAGTVGGDPFYTGNVRCSIGFSVHGGFVTAGHCGRAGQEVRGWDGSGIGNIQGSSFPDNDYAWVNVGSGWWTVPVVLGWGTVSDQLVRGSNEAPIGASICRSGSTSHWHCGNVLAKNETVNYSEGAVHQMTKTSVCAEPGDSGGSFISGDQAQGVTSGGWGNCSGGGETWYQPINEILNRYGLTLHTA

SEQ ID NO: 44198 - protein, 427 aa, Streptomyces sp. SirexAA-E
MAANGRHRRYQPSRINRASLTVTAGGAGIALPLLTAASAGAASTDVWEKVAACESTSNWHINTGNGYYGGLQFTRSTWAAYGGTAYAARADLATKDQQIAVAEKVLDGQGPGAWPACSVRAGLARGGDAPDIAPQTQRSRPVDGAKTAASKSAAPRAAKSAPRTAEAASPTSVPGARESYTVARGDSLSGIASTERVKGGWERLYAANRTVVGSDPDLIIPGQRLTLDVTGAPQRQAAKKSTQKATPKTDRKPAEQAARKEAVPKQTAPQRAAPKKTAPKQAEKTERKPAAEQRSGLSAPVSARTGTPYHQSGSWASGYHTGVDFPVPTGTSVKAVASGKVVSAGWAGAYGYEIVIRHADGKYSQYAHLSSLHVRAGQQVGSGQRIARSGTTGNSTGPHLHFEIRTGPGYGSDVDPLAYLRAGGVSV

SEQ ID NO: 44199 - protein, 296 aa, Streptomyces sp. SM8
MRLSLPHSLSRRARLITGATALAASAALVVPAATATAQPAPKTFSATQLNQTADSVRTADVAGTAWYVDAESGKVVVTVDSTVSKAEIAEIKDEAGANAAALEVKHTTGKFSKLIAGGEAITTGGARCSLGFNVQDSAGTKFALTAGHCTNIGSSWSIGTTTGSSFPGNDYGIIRHSNPSAADGRVYLYNGSYQEITGAGNASVGQSVQRSGSTTGLHGGSVTGLNATVNYGADGIVSGLIQTNVCAEPGDSGGALFAGSTALGLTSGGSGNCSSGGTTFFQPVTEALSAYGVSII

SEQ ID NO: 44200 - protein, 423 aa, Streptomyces sp. SM8
MAVRGRHRRRQQSRINRASLTVTAGGAGLALPLVAAGTADAASADTWAKVAACESSGDWSINTGNGYYGGLQFKQSTWEAYGGGAYAGRADLASKDQQIAVAEKVLDGQGPGAWPACSQKAGLTRGGPAPAAPEAAPAPRPAKAPAATPTTTPQSKAGTAEMYTVVRGDTLSQIAEEQRVKGGWQRLYQANRERVGTDPDLIVPGQRLQVKPGAATPPKDRPAPRAKDRTGPEPTGKQAAEKAAAKAAEAKKAEEARKAAAAKKAEEAQKAAAAKKKAEEAKKVSAPSTARFSSPVDAGTGTPYRASGASWSKGYHTGVDFPVPTGTSVKAAASGTVVSAGWGGSYGYQVVIKHNDGKYSQYAHLSALTVRSGQSVQAGQRIARSGSTGNSTGPHLHFEVRTGPGFGSDIDPLAYLRGGGVKV

SEQ ID NO: 44201 - protein, 270 aa, Streptomyces sp. SM8
MRAVTRREVGVALLGLAALAACSGEAAGAGGPGLETARKKEIAMRLVSSAENSSLDWRAQYRYIEDIGDGRGYTAGIIGFCSGTGDMLALVERYARERAGAELAGFLPALREVRGSASHRGLGGRFTRAWQRAADGDRAFRDAQDGERDRVYFDPAVARGRQDGLGALGQFCYYDARVMHGHGDAPGNVGFATIRRRALDTAPPPSRGGDETAYLHAFLDARVAAIAEEPSHTDTSRIDTAQRVFLREGNLRLDPPLVWKVYGDTYRIEE

SEQ ID NO: 44202 - protein, 177 aa, Streptomyces sp. SM8
MPHLLAAAVAALALLALGHAHRADPAGNPDCRSAPWPWGCVADCESDGRWDADTGNGHHGGLQFAPATWREFGGERYAPGAHLATAEEQIAVGRDVLRVQGWEAWPSCAKRYGLAGRAHTVEPGDTLTSVAARFRVPGGVEGLYRLNEETVGPDPDLLAVGVLLALPPGSGSGRAGG

SEQ ID NO: 44203 - protein, 192 aa, Streptomyces sp. SM8; identical to SEQ ID NO: 43417

SEQ ID NO: 44204 - protein, 384 aa, Streptomyces sp. SM8
MRRTTRRTTAARVGLSSLLLAGSWAAFGLTPAATAAPDPAPVASGAVLAGMERDLGLTPAEAKARLAAEKEATAVEKKAQRAAGAAYGGSWFDAEKGALVVAVSDRAAADAVTGAGASVRLVEHSAKTLDAAKERIDGLDAPRGVAGWRVDPQANSVVVSVVGDQADGKAVRGFVERARAAGPVEVETVAAAPETFAAGTVGGDPYYTGNVRCSIGFSVHGGFVTAGHCGPTGQGVSGWDGSGIGSFQGSSFPGDDMAYVSVGNGWWTVPVVLGWGTVSDQLVRGSAEAPVGASICRSGSTTHWHCGTVLAKNETVNYSQGAVHQMTKTSVCAEGGDSGGSFISGDQAQGVTSGGWGNCSGGGETWYQPVNEILGRYGLTLHTA

SEQ ID NO: 44205 - protein, 299 aa, Streptomyces sp. SM8; identical to SEQ ID NO: 43432

SEQ ID NO: 44206 - protein, 267 aa, Streptomyces sp. SM8
MSAVPERPETPEPRGVSRKNLLRAALGAGALPLLTGGGVALARDTTGTAGPLDPTPACDDGDDPTPEQMEGPYFKPNSPLRTGLAGPGTPGTPLTVGGYVFDRGCRPLADVLLDFWQADDAGAYDNTGFRFRGHQFTTAAGEFRLTTIVPGLYPGRTRHLHVKVQPPGGQVLTTQLYFPGEPRNATDALFDPALLMNVRDAGGGREATFDVVLAVGQGPGATTWAAGREYTTGDRVSYDGAAYRCLQSHRATAGWEPPRAPALWQRG

SEQ ID NO: 44207 - protein, 528 aa, Streptomyces sp. SM8
MRVSFVRARVRGAGRGPGRLRRVFAGAAVGALLVTLAGVAGPESVTASARAASLTEVTGFGSNPGNLRMFRYVPDGLPAGRPLVVAMHGCTQSAGGFDDETGWTKWADQWGFALVLPQQQSANNLNSCFNWFEAGDIRRDAGEALSIKQMTDRMKADVGSDPARVHATGLSAGAAMTNVMLAAYPDVFASGAPVAGLPYACATSVVAAYSCMNPGSNLTPAAWAAKVRDAYPGYAGPWPAVSVWQGTTDTTVVPANLTETVEQWTAVHGTDTTPDATGTVGGYPHAVYRDGDGRDVVETYTITGMGHGQPVDPGSGAEQCGTAGAYILDVNICAAYHIGRFWGLAEDGGGTDPGTPAQRAVIPSTAADDGYVKASASGTGAAVGALEGTMGAAVGRGTDGQHNRTLLSFDTSAVPDDATITRAYVTVSRASGSGDPWAGGNRLLIDVRSGCFGASCATAADDWAAPATASGAAELARFTSGRADSTAFTEVNRTGPTQLRLRLADAPASTAYLFLRTGAEAKLTVEWE

SEQ ID NO: 44208 - protein, 314 aa, Streptomyces sp. SM8
MKVRTLGRMKRVGCVLLALAPLATAAVFLLGPDPEADRVPGESGPSSSAAADGAAKTGRDGGPDDADRETEERIAKMPAGLAAPGKKELALQLAASADNSTLEWRTLYGYIEDLQDGRGYTAGIAGFCTGTHDLLGLVERYSEAHPDNGLAAYLPALREVDGSDSLEGLEGFPEAWEAEAEVPAFRKAQERERDQRYFDPAVRMAKIDGLGTLGQFVYYDAMLLHGPGKGADSFYGIRAAALEKAETKAAGGDERAYLEAFLDARRAVIREGKRFQRDTSRVDSAQRVFLRNGNLSLSTPLTWEIYGERFHLPG

SEQ ID NO: 44209 - protein, 426 aa, Streptomyces sp. SM8
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGTEVYHTLKKVLKRKGLATGLGDEGGFAPNLDSNRAALDLILEAVKEAGYVPGKDIALALDVAASEFYKDGSYEFEGKSRSAAEMTEYYEELVAAYPLVSIEDPLFEDDWAGWNVVTEKLGDKVQLVGDDLFVTNPERLARGIEEKSANALLVKVNQIGSLTETLDAVELAQRNGFKCMMSHRSGETEDVTIADLAVATNCGQIKTGAPARSERVAKYNQLLRIEEILDDAAVYAGRSAFPRFKG

SEQ ID NO: 44210 - protein, 192 aa, Streptomyces sp. SM8; identical to SEQ ID NO: 43418

SEQ ID NO: 44211 - protein, 292 aa, Streptomyces sp. SM8
MIRRVMSLLIALSAVVAALVVLPAATAQAAACANAWNASAVYTGGQSASYNGRNYTAKWWTQNERPGSSDVWADQGACGGGGGEQPSGFVVSEAQFNQMFPNRNSFYTYSGLTAALSSYPAFANTGSDEVKKREAAAFLANVSHETGGLVHIKEVNEANYPHYCDRNQPYGCPAGQAAYYGRGPIQLSWNFNYKAAGDALGIDLLNNPYLVEQNASVAWRTGLWYWNTQSGPGTMTPHNAIVNNRGFGETIRSINGSIECNGGNPAQVQSRIDKFTSFAQILGTTTGSNLYC

SEQ ID NO: 44212 - protein, 232 aa, Streptomyces sp. SM8; identical to SEQ ID NO: 43425

SEQ ID NO: 44213 - protein, 453 aa, Streptomyces sp. SM8
MRHIPLRRRVAAACTGVVAVGALTLAGLTGSATAAPEPRATPASAPDAALLRAMERDLGLTPAEARQRIAGEAAAADIAATLKQRLGASFAGARVTGDGATLIVATTDPAERRTITAAGARAERADHALAELEAAKAGLDAAAGRRAPEGVPLWYVDTTASRVVLQAADRAAADRFAAAAGVDRALVKVVRASEEPRTYADLRGGDAYYMNGSGRCSVGFPVKRGASQAGFVTAGHCGTVGTTTTGVNQQAQGTFQGSTFPGRDYAWVATNANWTPRNLVNGYGNADVTVAGSTQALVGASICRSGSTTGWRCGTVQQLNTSVTYPQGTVSGVTRTSVCAEPGDSGGSFISGNQAQGMTSGGSGNCSQGGTTYFQPLAPALSAYGLTLVTGNDGGGPGPTDPPTEPGGTWAAGTAYAVGATVTYGGTTYRCLQAHTAQAGWQPPNTPSLWQRV

SEQ ID NO: 44214 - protein, 360 aa, Streptomyces sp. SM8; identical to SEQ ID NO: 43431

SEQ ID NO: 44215 - protein, 345 aa, Streptomyces sp. SM8
MLSGNGRHRRPRQAPAFVVAAGVTGSAIAIPLLGAGSASAADTATWDRLAECESGGAWSTNAGNGYYGGLQVTQELWERHGGLSYAPSADLASRSQQIVVAERILDAEGTAAWATCAPAIGLKQGGESADVNPGVPSDTGTPSASPTSPADKGEGKGDTEDEDGKASGKDDKDKKDNKGEKGEKGKGEKKEKGEKGDAASATPSADPTSLPDGYPSATPDEEATEIPDAPSSAPSATPGEDEDSGGGRHRGGTAAEPGSGESREGSGRHASRGDRGDAPDASGAYTVKEGDSLSVIAWLHEVDGGWPALYEANKEIIGDDADHILPGQALDLGSDPAAEKDRIGR

SEQ ID NO: 44216 - protein, 215 aa, Streptomyces sp. SM8
MRMTRTASALAGLGLAVAAALGSVAPASAAAETSTPRSVAAYEASTENAAATRAFQEAVMKAVAEKRAANPGALAVTVTYDASAAPTFRSQIASSTSIWNGAVSNVRLQEGSNADFTYREGNDPRGSYASTDGHGRGYIFLDYAQNQQYNSTRVTTHETGHVLGLPDTYSGPCSQLMSGGGPGPSCTNAQPDAAERSRVEQLWANGLAEAAAEVR

SEQ ID NO: 44217 - protein, 435 aa, Streptomyces sp. SM8
MSVAAAGTGNTAVTGVTARRIIDSRGNPTVEVDVVLADGSLGRAAVPSGASTGAREAVELRDGDPARWHGKGVDRAVAHVGGEIAAAVRGRDALDQAGLDAVLIALDGTRAKSRLGANAVLGVSLATAKAAAASLRRPLYRYLGGEGAYLLPLPMMNIVNGGAHADNPLDFQEFMIAPVGADTFAEAVRMGSEVFHTLRRDLLAAGHSTGVGDEGGFAPSLRTAEEALDFVTAAIERTGYRPGADIGLVMDPASSEFFRDGVYDYAGEGVRRTSAEHAAHLAKLIDAYPVVSVEDPMAEDDWEGWRELTARVGDRCQLTGDDVFCTDEALVREGIRTGVGNSVLVKVNQIGTLTEALATVATAREAGWTVVVSHRSGETEDTTIADLAVATGCGQIKTGSLSRSDRTAKYNQLIRIEEELGDAARYAGGSVLRRG

SEQ ID NO: 44218 - protein, 428 aa, Streptomyces sp. SPB74
MLVPSIDVVVAREILDSRGNPTVEVEVGLDDGSTGRAAVPSGASTGAFEAIELRDGDANRYQGKGVEKAVLAVIEQIGPELVGYDATEQRLIDQAMSDLDATPDKSSLGANAILGVSLAVAHAASEASDLPLFRYLGGPNAHLLPVPMMNILNGGSHADSNVDIQEFMIAPIGAESFSEAVRWGAEVYHTLKKVLKERGLSTGLGDEGGFAPNLDSNRAALDLIVEAIKEAGYVPGRDVALALDCAASEFYKDGKYLFEGQERSAAQMTEYYEDLVASYPLVSIEDPLFEDDWAGWATVTERLGDKVQLVGDDLFVTNPERLQRGIDEKSANALLVKVNQIGSLTETLDAVELAQRNGFKCMMSHRSGETEDVTIADLAVATNCGQIKSGAPARSERVAKYNQLLRIEEILDDAAVYAGRSAFPRFKG

SEQ ID NO: 44219 - protein, 240 aa, Streptomyces sp. SPB74
MLFSGKAKHRRRRTTRIVAFAGVTGAAIAVPLMATGSASAASTSTWDAVAQCESGGNWSINTGNGYYGGLQFNQSSWAAAGGTQYAPRADLATKDQQIATAERLLDMQGPGAWSCAGAGNLSNDGVDPGVNPNGGGQQTQERSSGDQSASRSQQRQAAPQQQAPRQQHTTPKSTTGTVKTDTGITVPKGDGEYKVVKGDSLSEIAQKHHVSGGWNKLFELNKDIVKDADLIYPGQQLHLS

SEQ ID NO: 44220 - protein, 338 aa, Streptomyces sp. SPB74
MLSGNGRHRRPRQAPALVVAAGVTGSAIAIPLLGAGTASADQGPWDRLAQCETGGDWAADKGNDYYGGLQLSEDEWEANGGLDLAPRADMATPAQQIQVGQRILAAQGPSAWPGCALSAGLTAEDGSTTSTTVPQDAPSAEDTDQARQDKKDGKTDPSAPESADPSASSTPDATDTPTPDASASPSDEDGTKAEDGTGSKADATGKSRARHAKPDPSDASDGSAGPAAPSGSAAAPGADPADETSATSGAGRDSGADRSAPGGRHAAPDAAGQKGADGADKADVYKVREGDNLWSIAEEHEVPGGWTGLYEQNKKIVGDDPDLILPGQSLDLGADSGQ

SEQ ID NO: 44221 - protein, 431 aa, Streptomyces sp. SPB74
MALRGRHRRPQPPRIQRASLTVTAGGAGLALPLVAAGGATAATEQTWDKVARCESGGDWDINTGNGFYGGLQFTTSTWKAFGGGAFAARADQATRAEQIVVAEKVLKNQGPHAWPTCGSRAGLARGGPAPAVRQASAPDATKARPAAAPKAGPREKAAASAERLPTRRPSAAHGPDKTPQLRAGTARLYTVVPGDSLSGIADERHVEGGWERLYALNRGTVGADPDLIRPGQHLALSGRPGPRTAERAPERRAAPKKAEPKKAAPPKRQPEKPAPRKAAPEKAEKAAATPKKAAPAGHRLTAPVAAGTGTQYRAAGSSWSKGYHTGVDFPVPTGTTVKAIGAATVVSAGWGGSYGYQVVLRHADGRYSQYAHLSALNVRAGQHVAEGQRIARSGATGNVTGPHLHFEVRTGPGFGSDIDPLAYLRAGGVRI

SEQ ID NO: 44222 - protein, 385 aa, Streptomyces sp. SPB74
MHRRPVMRTALSALALLGGLGVVAGTGTAAQADSKPEQPASASLLTAMQKDFHLTARQAEDRLAAEKQAARTDRAARKAAGSAFAGSWFDAKKGTLTVALTGTRAAGAVRATGAEVRTGARHSASELASVKREIDRIKAPASVTGWRVDPRANSVVVDVAASHRTDRAVRDFLTRARDAGPVAVHAVEGAPERPRPLAAGTVGGDPFYTGNVRCSIGFSVVGGFVTAGHCGQPGQAVYGWDNSYIGNIQGSTFPGDDMAWVNVGSGWWTTPVVLGWGTVSDQLVRGSNVAPVGSSICRSGSTSHWHCGTVLGLNETINYANGPVYEATHTNACAEPGDSGGSFISGDQAQGVTSGGFGNCSSGGETWFQPVNEILGRYGLTLVTA

SEQ ID NO: 44223 - protein, 270 aa, Streptomyces sp. SPB74
MALALAVPTASYALASPEHGASAVARAEQTRTKAAAGLDDPAKKEIAMELVSSAENSSLDWKDQYRYIEDIGDGRGYTAGIIGFCSGTGDMLDLVELYAKRAPGNVLAPYLPALREVNGGDSHAGLGSAFEDAWRTAAKDPAFQQAQNDERDRVYFDPAVAQGKKDGVGTLGQFTYYDAIVMHGPGNGGTSFGGIRARALREARPPAEGGDETVWLNAFLDARVWAMKQEEAHSDTSRVDTAQRVFLNAGNLGLEPPLEWKVYGDSYRIG

SEQ ID NO: 44224 - protein, 406 aa, Streptomyces sp. SPB74
MRRLRAVLCGAAASALAAAGLTALLPASASGAESATLDKRWYAAAPYLMPLDNDPPSATAIMDASGLKAFQLAFILAPNGGGCSPTWDGTAPVSSDTAVGSVISAIRAKGGDVSVSIGGYGGTKLGQSCTDAASTAAAYQQVITKYQLKAIDFDLEEPEYENTAAIAREIGAAKILQKNNPGLYVSVTTAGTADGTGWFGKQMLNEAKAQGFTPDNFSIMPFDGGFNGAASQTAALTAFNGVLRSTFGWSEATAYAHEGFSGMNGRSDTGEYFGQADFQTVLDYTTTHGMARFTFWSLNRDRQCSPADNGGRTSGTCSSVPQSAWDFAKFSVKFAGATPPANPPTDPPTDPGTGQCAAGAWSAGAVYVKGDKVTQDGHTWEAKWWTTNEKPGTTGEWGAWQDDGPC

SEQ ID NO: 44225 - protein, 299 aa, Streptomyces sp. SPB74
MRTKRTTPRTGTTRRTRLIAVASGLLATAAFAVPAAQAGEAKTYSTNQLTAVGDAVLKADVAGTAWNVDPSNGKVQLTVDSTVSQAEIQKLKDAAGKNAGALEIERTPGTFSKLVSGGDAIYASSWRCSLGFNVRSGSTYYFLTAGHCTDGAGTWWSNSSHTTTLGTTAGSSFPGDDYGLVKYTNSSVPKDGTVGSVDITSAANATVGMSVTRRGSTTGIHSGTVSALNATVNYGADGIVSGLIRTNVCAEPGDSGGPLYSGNQAIGLTSGGSGNCSSGGTTFFQPVTEALSAYGVSVY

SEQ ID NO: 44226 - protein, 360 aa, Streptomyces sp. SPB74
MTERRTTVRRAAIAGTGVAALLAAGFTFQTANAAEATPTAPHTLSAPKAEKLASRLTQDLGTHAAGTYYDAQAKHLVVNVTNQSAAKTAEAAGAKARVVAHTLAELRSARSAVAKETTAIPGTSWGVDPVSNKVVVTADRTVKGAQLKKLTTAVGKLGSMATLKQSKGTFKPFIAGGDAITGSGGRCSLGFNVTVGGEPAFLTAGHCTEAIDNWTDADGNALGSNAGSEFPGNDYGLVKYSSDVDHPSEVDLYNGSSQSITGAADATVGQTVTRSGSTTGVHSGEVTGLDVSVNYGADGIVDGLIQTTVCAEPGDSGGSLFAGSDAVGLTSGGSGDCTSGGETFFQPVTEALSAFGADIG

SEQ ID NO: 44227 - protein, 200 aa, Streptomyces sp. SPB74
MGLVLHQGFLRLRLVFARPRPCGGPRGAGPSGGEGRAGWRVPPGRKCAGRAGARSRPGGARGSRSRGPSGEGARGAVRRVPPGRGFGGSRCGPPGRVAGCGPGGRGVRSARGGSAVQLVEKRLLVAGRSSIEAPGGSGSGGRDPYGPGGLHGACVPWGRARLAGLPGSRTLRGPRACWAPETCWPCGLLGLRAALGLAGR

SEQ ID NO: 44228 - protein, 360 aa, Streptomyces sp. SPB78
MTERRTTVRRAAIAGTGVAALLAAGFTFQTANAAEATPTAPHTLSAPKAEKLASRLAQDLGAHAAGTYYDAQAKHLVVNVTNQSAAKTAEAAGAKARVVAHTLAELKSARSAVAKETTAIPGTSWGVDPVSNKVVVTADRTVKGAQLKKLTTAVEKLGTAATLKQSKGTFKPFIAGGDAITGSGGRCSLGFNVTVGGEPAFLTAGHCTEAIDNWTDADGNALGSNAGSEFPGNDYGLVKYSSDVAHPSEVDLYNGSSQSITGAADATVGQTVTRSGSTTGVHSGEVTGLDVSVNYGADGIVDGLIQTTVCAEPGDSGGSLFAGSSAVGLTSGGSGDCTSGGETFFQPVTEALSAFGAEIG

SEQ ID NO: 44229 - protein, 299 aa, Streptomyces sp. SPB78
MRTKRTTPRTGTTRRTRLIAVASGLLAIAAFAVPAAQAGEEKAYSTNQLTAASDAVLGADIAGTAWNIDPSNGKVQVTVDSTVSQAEIQKLKAAAGSNAGALEIERTPGTFSKLISGGDAIYASSWRCSLGFNVRSGSTYYFLTAGHCTDGAGTWWSNSSHSTTLGTTAGSSFPGNDYGLVKYTNSSVAKDGTVGSVDITSAANATVGMNVTRRGSTTGIHSGTVSALNATVNYGADGIVSGLIRTNVCAEPGDSGGPLYSGNKAIGLTSGGSGDCSSGGTTFFQPVTEALSAYGVSIY

SEQ ID NO: 44230 - protein, 284 aa, Streptomyces sp. SPB78
MALALAVPGASYALASPAPTPAPTPAATPAPAPAASAGARAEQARTKAATGLDDPAKKEIAMQLVSSAENSSLDWKDQYRYIEDIGDGRGYTAGIIGFCSGTGDMLDLVERYARTTPGNALAPYLPALREVNGTDSHDGLGSAFEDAWRTAAGDPAFQQAQNDERDRVYFGPAVAQGKEDGVGTLGQFIYYDAIVMHGPGDDGTSFGGIRARALREARPPAEGGDETAWLNAFLDARVWAMKQEEAHSDTSRVDTAQRVFLDAGNLGLEPPLEWKVYGDSYRIG

SEQ ID NO: 44231 - protein, 499 aa, Streptomyces sp. SPB78
MRVPIVRMHELMSRTSSRVLSVALSVGGLLALAGTSPASAASVATWDKVAQCESSGNWQTNTGNGYYGGLQISLGTWRAYGGGEYATYPHQATKKEQILTAEEILAGQGAGAWPTCGSKAHLADDHENPYPEIQPPVPTPEVPKAEPTQRVHADFNGDGRDDVAAVYGYDDHTVSVFTFLAKSDGGFEAPVKSWTSQPNYWTFKSVKMTAGDYNGDGRAELAAMYDYADGSVAMFTWPTNTDGTFKAPQKSWTTEPGNWYPKHVQLASGDYDGNGRDDIAAFYGYSDGRAALFTFKGQTDGGFAAPAKSWNVPEAYWWGDNVKFTSGDFNGDGRTDAAAIYGYDDGTVSAFTWIANTNGGFATPTKSWTRPPGNWTFESIKLTSGDYNGNGRDDLAAMYDYADGSAAMFTWLTDADGTFQSPQKSWTTEPGNWYPEHVQLASGDYDGNGRDDIAAFYGYSDARAALFTFKPNTSGEFAAPVKSWNVPADHWWGEHVKLG

SEQ ID NO: 44232 - protein, 420 aa, Streptomyces sp. SPB78
MRRLHTPWEIPVRRLRALLCGAAASALAAAGLTALLPASASGAESATLDKRWYAAAPYLMPLDNDPPSATAIMDASGLKAFQLAFVLAPNGGGCSPTWDGTAPVSSDTAVGSVISAIRAKGGDVSVSIGGYGGTKLGQTCSDAASTAAAYQQVITKYQLKAIDFDLEEPEYENTAAIAREIGAAKILQKNNPGLYVSVTTAGTADGTGWFGKQMLNEAKAQGFTPDNFSIMPFDGGFNGAASQTAALTAFNGVLRSTFGWSEATAYAHEGFSGMNGRSDTGEYFSQADFQTVLDYTTAHGMARFTFWSLNRDRQCSPADNGGRTSGTCSSVPQSAWDFAKFSVKFAGATPPTNPPTDPTDPPTDPGTGQCTAGAWSAGAVYVKGDKVTQDGHTWEAKWWTTNEKPGTTGEWGVWQDDGPC

SEQ ID NO: 44233 - protein, 731 aa, Streptomyces sp. SPB78
MTPATGSLWPDAVFADPDPDTDAESYAFSAKIVDSYTRLSTMAQAYSQQGTGLTGNTALRDAVVTGLDHLHAQVYNDRQTRYGNWYSWQIGAPQALLDTCVLMYDALGAARIDAYCAAVDHFVPDSAVGSYTGTSTGANRVDLCRVLALRGVVGASSAKLALARDALSPVFPYVTSGDGLHSDGSFIQHTTVPYTGSYGSVMLGGLGMLFALLKGTQWEVTDPRRQIVFDAVEGAWAPFLYNGLVMDSVAGRAISRGLTSTAPDAVQQNDHLRGHPILASIVLLGQGASATENARWRALVKGWARRDYYSPPLENPTLGLTALSRLASVFDDSSVTALPEPTGHRLFTDMARATHRRPGWAASLSMADRRITYYETGNGENLRGWHTGSGMLYWWGDTYANGQYSDAFWPTVDPYRLPGITASRKALADAAGGDWGASLPDVNWVGGVTDGQRASVGQYLKGLSSTLLAKKSWFFLDDTVVALGAGITGTDGAAVETTVDNRNLGPTGGSAFTVDGATKPLAFPWSATLTGASWAHLAGHGGYVFPGGATVKALRESRTGSWRDINTGGATTSVSRKYLTLWFDHGKDPRQASYAYQLLPGADAARTAARAADTTWLRVLANTDDQQGVSVPSLGLTAVNFWFGGTVGTLVADNPCSVMVTEHSDGTATVCVSDPMRMRTNLTVTWNRAVAAVVSKPSTVSSAATGASLRLVFGDLSGTRGTTQTVKVRLA

SEQ ID NO: 44234 - protein, 431 aa, Streptomyces sp. SPB78
MALRGRHRRPQPPRIQRASLTVTAGGAGLALPLVAAGGATAATEQTWDKVARCESGGDWDINTGNGFYGGLQFTTSTWKAFGGSAYASRADQATRAEQIVVAEKVLKSQGPHAWPTCGPRAGLARGGPAPAVQPASARAKPKTETKAEAAPKAAPQARPKEKAAASAERLTTRKPPASHGPDKTPQSRAGTAQLYTVVPGDSLSGIAAERQVEGGWERLYALNRGTVGADPDLIRPGQHLALSGKPGPRTAERVPEKKAAPKKAEPRKTEPRKAEPKKAAPKKAEKAAAPRKAASTGHSLTAPVSAGTGTQYRAAGSSWSKGYHTGVDFPVPTGTTVKAIGAGTVVSAGWGGSYGYQVVLHHADGRYSQYAHLSALNVRAGQHVAEGQRIARSGATGNVTGPHLHFEVRTGPGFGSDVDPLAYLRAGGVHI

SEQ ID NO: 44235 - protein, 385 aa, Streptomyces sp. SPB78
MHRRPVMRIALSTLALLGGLGVAAGTGTAAQADSKPEQPASAGLLTALQKDFHLTAQQAEQRLAAEKQAAKTDRAAREAAGSAFAGSWFDAKKGTLTVALTGTRTADAVRATGAEVRTGARHSEARLTSVKRAIDRIKAPTSVTGWRVDPRTNRVVVDVLAKDRSDKAVRAFLTKAEDAGPVTVHAVEGAPEKPRPLAAGTVGGDPFYTGNVRCSIGFSVVGGFVTAGHCGQPGQAVYGWDNSYIGNIQGSTFPGDDMAWVNVGSGWWTTPVVLGWGTVSDQLVRGSNVAPVGSSICRSGSTSHWHCGTVLGLNETINYANGPVYEATHTNVCAEPGDSGGSFISGDQAQGVTSGGFGNCTSGGETWFQPVNEILGRYGLTLVTS

SEQ ID NO: 44236 - protein, 428 aa, Streptomyces sp. SPB78
MLVPSIDVVVAREILDSRGNPTVEVEVGLDDGSTGRAAVPSGASTGAFEAIELRDGDANRYQGKGVEKAVLAVIEQIGPELVGYDATEQRLIDQAMSDLDATPDKSSLGANAILGVSLAVAHAASEASDLPLFRYLGGPNAHLLPVPMMNILNGGSHADSNVDIQEFMIAPIGAESFSEAVRWGAEVYHTLKKVLKERGLSTGLGDEGGFAPNLDSNRAALDLIVEAIKEAGYVPGRDVALALDCAASEFYKDGKYRFEGQDRTAAEMTSYYEELVGAYPLVSIEDPLFEDDWEGWATVTERLGDKVQLVGDDLFVTNPERLQRGIDEKSANALLVKVNQIGSLTETLDAVELAQRNGFKCMMSHRSGETEDVTIADLAVATNCGQIKSGAPARSERVAKYNQLLRIEEILDDAAVYAGRSAFPRFKG

SEQ ID NO: 44237 - protein, 241 aa, Streptomyces sp. SPB78
MRRPSMLFSGKAKHRRRRTTRIVAFAGVTGAAIAVPLMATGSASAASTSTWDAVAQCESGGNWSINTGNGYYGGLQFSQSSWAAAGGTQYASRADLATKDQQIATAERLLDMQGPGAWSCAGAGNLSNDGVDPGVNPSGGGQQSQPQERSSSDQSASRSQERQAPQQQHTTPKSTTGTVKTDTGITVPKGDGEYKVVKGDSLSEIAQKHHVSGGWNKLFELNKDVVKDADLIYPGQQLHLS

SEQ ID NO: 44238 - protein, 348 aa, Streptomyces sp. SPB78
MLSGNGRHRRPRQAPALVIAAGVTGSAIAIPLLGAGTASADQGPWDRLVECETGGDWAADNGNDYYGGLQLSDEEWEANGGLDLAPRADMATPAQQIQVGQRILAAQGPSAWPGCALSAGLTAEDGSTASTPAPQDTPSATETGKAQTDKQDKKEKKGKEADDSSSSSASADPSASKTPDADASGEAPSADASASPSGKDKDGATGKDGATGQSRGKHAKPDSSASSSETADATGSASPSESTTVPGGDPSGETSATSGDDRDSGADRSAPGGRHAATDTEGQKGADGADKTDAYKVREGDNLWSIAEAHELADGWTGLYEQNKKIIGTDPDLILPGQSLDLGADSGR

SEQ ID NO: 44239 - protein, 809 aa, Streptomyces sp. Tu6071
MSPAWSRRTFLAAAGGAALTAGSLLPSSAAAATAADPYTALRATWRTLILGEGFSPTAEPFKSRLADLGSQAGTWHDSMTPATGSLWPDAVFADPDPDTDAESYAFSAKIVDSYTRLSTMAQAYSQQGTGLTGNTALRDAVVTGLDHLHAQVYNDRQTRYGNWYSWQIGAPQALLDTCVLMYDALGAARIDAYCAAVDHFVPDSAVGSYTGTSTGANRVDLCRVLALRGVVGASSAKLALARDALSPVFPYVTSGDGLHSDGSFIQHTTVPYTGSYGSVMLGGLGMLFALLKGTQWEVTDPRRQIVFDAVEGAWAPFLYNGLVMDSVAGRAISRGLTSTAPDAVQQNDHLRGHPILASIVLLGQGASATENARWRALVKGWARRDYYSPPLENPTLGLTALSRLASVLDDSSVTALPEPTGHRLFTDMARATHRRPGWAASLSMADRRITYYETGNGENLRGWHTGSGMLYWWGDTYANGQYSDAFWPTVDPYRLPGITASRKALADAAGGDWGASLPDVNWVGGVTDGQRASVGQYLKGLSSTLLAKKSWFFLDDTVVALGAGITGTDGAAVETTVDNRNLGPTGGSAFTVDGATKPLAYPWSATLTGASWAHLAGHGGYVFPGGATVKALRESRTGSWRDINTGGATTSVSRKYLTLWFDHGKDPRQASYAYQLLPGADAARTAARAADTTWLRVLANTDDQQGVSVPSLGLTAVNFWFGGTVGTLVADNPCSVMVTEHPDGTATVCVSDPMRMRTNLTVTWNRAVAAVVSKPSTVSSATTGASLRLVFGDLSGTRGTTQTVKVRLD

SEQ ID NO: 44240 - protein, 409 aa, Streptomyces sp. Tu6071
MRRLRALLCGAAASALAAAGLTALLPASASGAESATLDKRWYAAAPYLMPLDNDPPSATAIMDASGLKAFQLAFVLAPNGGGCSPTWDGTAPVSSDTAVGSVISAIRAKGGDVSVSIGGYGGTKLGQTCSDAASTAAAYQQVITKYQLKAIDFDLEEPEYENTAAIAREIGAAKILQKNNPGLYVSVTTAGTADGTGWFGKQMLNEAKAQGFTPDNFSIMPFDGGFNGAASQTAALTAFNGVLRSTFGWSEATAYAHEGFSGMNGRSDTGEYFSQADFQTVLDYTTTHGMARFTFWSLNRDRQCSPADNGGRTSGTCSSVPQSAWDFAKFSVKFAGATPPTNPPTDPTDPPTDPGTGQCTAGAWSAGAVYVKGDKVTQDGHTWEAKWWTTNEKPGTTGEWGVWQDDGPC

SEQ ID NO: 44241 - protein, 305 aa, Streptomyces sp. Tu6071
MNLKTPHTPSTAPHHSRSARARRLRRLAPFVVALALAVPGASYALASPAPAPAPAASAGARAEQARTKAATGLDDPAKKEIAMQLVSSAENSSLDWKDQYRYIEDIGDGRGYTAGIIGFCSGTGDMLDLVERYARTTPGNVLAPYLPALREVNGTDSHDGLGSAFEDAWRTAAGDPAFQQAQNDERDRVYFDPAVAQGKEDGVGTLGQFIYYDAIVMHGPGDDGTSFGGIRARALREARPPAEGGDETAWLNAFLDARVWAMKQEEAHSDTSRVDTAQRVFLDAGNLGLEPPLEWKVYGDSYRIG

SEQ ID NO: 44242 - protein, 426 aa, Streptomyces sp. Tu6071
MSFTVASLDAVEILDSRSRPTLQVALALGDGTRAVAGVPAGASTGSREAVELRDGDPDRYAGQGVLRAAAHVREDLAALLGSRAWDSLAEADLAMDALDGTGTKARLGANAIVGVSLALARALAASAGVEPYTYLAPEGVTPRLPVPHFNVLNGGVHAPNPLDFQEFMIAPLGAPSLAEAVRAGSEVYGALKRLLRERGYDTGLGDEGGFAPDLVQPEDALRLLVQAIGDAGYTAGREGVALALDPASSEFRQEDGTYRVAGESLSGSDMITRYEAIVADFPVWSLEDGLGEDDTEGWQELTRRLGARVQLVGDDNLVTRPALIREAITDGIANAALIKVNQIGTVTETLEAMRLCRENGYGAQISHRSGETPDPFIADLAVATGCGQMKSGAPARGERVAKYNRLLEIAKARPELPYGPARGREG

SEQ ID NO: 44243 - protein, 486 aa, Streptomyces sp. Tu6071
MRPPLLRRLGRLLVSALLAATACTFALPSPASAAGGLTQVTGFGSNPGNLAMYTYVPDGLPPNAPVVVALHGCAQSANDYYANSGWTTMADRYKFAVVFPQTSAANNSLSCFTWFDPADTGRGKGEVASVVSMVDKAAQLYGSDRARVYVTGLSAGGGMTANLLAAYPDVFAGGAVDSGLPAQCATSQTGASGCQYGSLNLTPAQWGDKVRAQNPGYAGPWPRVAIWQGTSDYTVYPVNATELRDQWTNVWGLSQTPSSTTTLPGSTTLTSYDDAGGEPAVQLYQISGMGHGLAVDPGTGEEQCGKSAAYFLDTICSSYYTAHFWGLDGAGTGPGDGDALPAPAGLKAGTPTATSVPLSWSAVAGAASYHVYRGGTRVGTPSGTSFTDSALTAGTSYTWTVTAVDNTGKEGARSAPVTASTTGGGTPATCVTANNYAHVAAGRAHVSGGYAYTNGGNQNMGLYNVFVTHTLRQTGPDSWELADGAC

SEQ ID NO: 44244 - protein, 379 aa, Streptomyces sp. Tu6071
MRIALSTLALLGGLGVAAGTGTAAQADSKPEQPASAGLLTALQKDFHLTAQQAEQRLAAEKQAAKTDRAAREAAGSAFAGSWFDAKKGTLTVALTGTRTADAVRATGAEVRTGARHSEARLTSVKRAIDRIKAPTSVTGWRVDPRTNRVVVDVLAKDRSDKAVRAFLTKAEDAGPVTVHAVEGAPEKPRPLAAGTVGGDPFYTGNVRCSIGFSVVGGFVTAGHCGQPGQAVYGWDNSYIGNIQGSTFPGDDMAWVNVGSGWWTTPVVLGWGTVSDQLVRGSNVAPVGSSICRSGSTSHWHCGTVLGLNETINYANGPVYEATHTNVCAEPGDSGGSFISGDQAQGVTSGGFGNCTSGGETWFQPVNEILGRYGLTLVTS

SEQ ID NO: 44245 - protein, 348 aa, Streptomyces sp. Tu6071
MLSGNGRHRRPRQAPALVIAAGVTGSAIAIPLLGAGTASADQGPWDRLVECETGGDWAADNGNDYYGGLQLSDEEWEANGGLDLAPRADMATPAQQIQVGQRILATQGPSAWPGCALSAGLTAEDGSTASTPAPQDTPSATETGKAQTDKQDKKEKKGKEADASSSSSASADPSASKTPDADASGEAPSADASASPSGKDKDGATGKDGAAGQSRGKHAKPDSSASSSETADATGSASPSESTTVPGGDPSGETSATSGDDRDSGADRSAPGGRHAATDTEGQKGADGADKTDAYKVREGDNLWSIAEAHELADGWTGLYEQNKKIIGTDPDLILPGQSLDLGADSGR

SEQ ID NO: 44246 - protein, 236 aa, Streptomyces sp. Tu6071
MLFSGKAKHRRRRTTRIVAFAGVTGAAIAVPLMATGSASAASTSTWDAVAQCESGGNWSINTGNGYYGGLQFSQSSWAAAGGTQYASRADLATKDQQIATAERLLDMQGPGAWSCAGAGNLSNDGVDPGVNPSGGGQQSQPQERSSSDQSASRSQERQAPQQQHTTPKSTTGTVKTDTGITVPKGDGEYKVVKGDSLSEIAQKHHVSGGWNKLFELNKDIVKDADLIYPGQQLHLS

SEQ ID NO: 44247 - protein, 447 aa, Streptomyces sp. Tu6071
MQRKTPQGPPQTCSTSQKEMLVPSIDVVVAREILDSRGNPTVEVEVGLDDGSTGRAAVPSGASTGAFEAIELRDGDANRYQGKGVEKAVLAVIEQIGPELVGYDATEQRLIDQAMSDLDATPDKSSLGANAILGVSLAVAHAASEASDLPLFRYLGGPNAHLLPVPMMNILNGGSHADSNVDIQEFMIAPIGAESFSEAVRWGAEVYHTLKKVLKERGLSTGLGDEGGFAPNLDSNRAALDLIVEAIKEAGYVPGRDVALALDCAASEFYKDGKYRFEGQDRTAAEMTSYYEELVGAYPLVSIEDPLFEDDWEGWATVTERLGDKVQLVGDDLFVTNPERLQRGIDEKSANALLVKVNQIGSLTETLDAVELAQRNGFKCMMSHRSGETEDVTIADLAVATNCGQIKSGAPARSERVAKYNQLLRIEEILDDAAVYAGRSAFPRFKG

SEQ ID NO: 44248 - protein, 457 aa, Streptomyces sp. W007
MERTTLRRRALAVGTATVAVGALALAGLTGVASADPAATTAPPVSADSLSPGMLDALERDLGLDADAARSRIANEYRAAAVAAGLEKSLGASFAGARVSGAKAALTVATTDASEAARITDAGARAEVVGHSLDRLEGVKKTLDKAALSTAPKDVPVWYVDVEANRVVVNAASTAAGQAFLKAAGVDSGLVTVARSAEQPRALADIRGGDAYYMNGSGRCSVGFSVTRGTQGGFATAGHCGRVGTTTNGVNQQAQGTFQGSTFPGRDIAWVATNANWTPRPLVNGYGRGDVTVAGSTASVVGASVCRSGSTTGWHCGTIQQLNTSVTYPEGTISGVTRTSVCAEPGDSGGSYISGSQAQGVTSGGSGNCSSGGTTYFQPINPLLQAYGLTLVTSGGGTPTDPPTTPPTDPPGGTWAAGTAYAAGATVTYGGATYRCLQAHTAQPGWNPADVPALWQRV

SEQ ID NO: 44249 - protein, 283 aa, Streptomyces sp. W007
MDNATPHDPNASDEASGDRRRISRKGLLKAALVASAAPLLAGGGVALARDAASTGNGPLAPTPECDDGDDTTPPQMEGPYFKPNSPRRTSLVTPSTPGIPLTVSGYVFGRACRPISGALLDFWQADTNGAYDMAQFAFRGHQFTGTDGSFSLTTIVAGLYPGRTRHIHVKAQAPGGRILTTQLYFPNEPRNNTDALFDPELLMNVRNVGNGRQGTFDFVLDVAQTPTPTDPPTEPGSTTWATGTSYRAGDRVTYGGVAYRCLQAHQAVSGWEPPNVPALWERG

SEQ ID NO: 44250 - protein, 299 aa, Streptomyces sp. W007
MRIKRTSNRSNAARRVRTTAVLAGLAAVAAMAIPTANAETPRTFSANQLTAASDAVLGADIAGTAWNIDPQSERLVVTVDSTVSKAEINRIKKSAGANADALRIERTPGKFTKLISGGDAIYSSTGRCSLGFNVRSGSTYYFLTAGHCTDGATTWWSNSARTTVLGTTSGSSFPNNDYGIVRYTNTTIPKDGTVGGQDITSAANATNGMAVTRRGSTTGTHSGSVTGLNATVNYGGGDVVYGMIRTNVCAEPGDSGGPLYSGTRAIGLTSGGSGNCSSGGTTFFQPVTEALSAYGVSVY

SEQ ID NO: 44251 - protein, 361 aa, Streptomyces sp. W007
MKHRRISRKRATLAGSAVVALVAAGFTFQTANASDDVPVFAAKTLSADAAGKLATALDRDLGADAAGSYYDTTAKALVVNVVDEAGAEQVRQAGGKARIVENSLAELKSARGALTEKATIPGTSWAVDPVSNKVLVTADSTVDGAAWKKLTAVVEGLGGKAELNRTAGEFTPLIAGGDAIWGSGSRCSLGFNVVKGGEPYFLTAGHCTESVTSWSDTQGGSEIGANEGSSFPENDYGLVKYTSDTAHPSEVNLYDGSTQAITQAGDATVGQAVTRSGSTTQVHDGEVTALDATVNYGNGDIVNGLIQTTVCAEPGDSGGALFAGDTALGLTSGGSGDCSSGGTTFFQPVPEALAAYGAEIG

SEQ ID NO: 44252 - protein, 326 aa, Streptomyces sp. W007
MPNTAFRRLTGVALSATLATVTLAVNAPQAAAAETPSLRVLSYNAFIFSKTLYPNWGQDHRAAEIPKTSFFRGNDVVVIQEAFDNGASDALLRNSASQYPYQTPVVGRSKSGWDATGGSYAAATPEDGGVTILSKWPIVRKEQFVFKDACGGDWFSNKGFAYTVLNVNGARVHVVGTHAQSTDPGCSAGEAAQMRSRQFKQMDAFLDAKNIPASEQVVVAGDFNVDGHSAEYASFLSDAGLSAPESRTGHPYSFDTRDNSIASERYPDDPREDLDHVLHRTGHAKPSGWKNDVIKEQSAPWTVSSWGKNYTYTNLSDHYPVIGSGQ

SEQ ID NO: 44253 - protein, 147 aa, Streptomyces sp. W007
MRRNSHAIFVTFTVSALLFGGFATATAQAAPAKAESLYAPSALVLTVARGEDPLTATVERAVTLTCAPTAEGTHPDPAAACKELAEVRGKFSELTAGPSNRTCTRQWDPVLVTAHGVWQGKQVQFSTTYGNACEMAGSMNDNAVFAF

SEQ ID NO: 44254 - protein, 376 aa, Streptomyces sp. W007
MLRTGLSALLLLGAWAAAGPSTASAAPIDSTEAPASAALLTAMQRDFGLTEGEAVARLADEKAATALEPKAQRAAGSAFGGSWFDARTGKLVVAVTNAGKAEAVRATGADTRLVEHSAKQLDAAKARVDALPAPSGVSSWHVDPATSSVVVNVVASEQRDNDVRSFVAKAREAGPVTVETTAEAPQTFAAGTVGGDPYYTGNVRCSIGFSVHGGFVTAGHCGGAGQSVRGWDGSAIGNFQGSSFPGDDYAWVNVANGWWTVPVVIGWGTVSDQLVRGSNEAPVGASICRSGSTTHWHCGNVLAKNETVNYSQGAVHQMTKTSVCAEGGDSGGSFISGDQAQGVTSGGWGNCSGGGETWYQPVNEILNRYGLTLHTA

SEQ ID NO: 44255 - protein, 439 aa, Streptomyces sp. W007
MTAGGAGIALPLITAASAGAAPVEVWEKVAACESSGNWAVNTGNGYYGGLQFSGPTWAAFGGTQYAARADLATRDQQIAVAEKVLDGQGPGAWPTCSVRAGLTRGGDAPGTAPEAETDTQSAGSRPVRAAAPQSAPPRQPRTLPAEATPTHVPGKRDSYTVASGDSLSGIASAQRVRGGWQGLYAANRTVVGGDPDLIFPGQRLSLDRSRAPKAGEGKSSGQPARKTAPKPPAVTPEAKKADQRTAAPKKEAPPQAAPKKEAPKQRAPEKAAPKQQAPKKEAPKKEAPKKAAPQRERPAPERAVKHSGFSAPVSAGTGTPYRQAGGWSSGYHTGVDFPVPTGTSVKSVAPGRVVSAGWAGAYGYEVVIRHSDGKYSQYAHLSALHVRAGQSVSGGQRIARSGSTGNSTGPHLHFEIRTGPGYGSDVDPLAYLRAGGVRV

SEQ ID NO: 44256 - protein, 153 aa, Streptomyces sp. W007
MVTLRYDDSRAGGWEAEIAAGVASWNSNVDNVKLVEAAPGTRAEIQIVATSGWPQATLGPVRPGGQVRVELGSQAVAQGHDKTRIAAHEIGHSLGLPDTKPGPCSQLMSGSSAGISCRNALPNAAEQSRVESAYAGGLAPRVPADGRVLVDAP

SEQ ID NO: 44257 - protein, 850 aa, Streptomyces sp. W007
MGAVLPLALAGAMGVALLVQPAQAQPNSPSVATASNASQPSRPAGSADPAPQAQQSPASDAGHQAKNRLKASQLPPLSADKSPLKEAYGEHDAPSKQGAGKKSSAKAAAACDPADFTGRTGSELVRFIKASTTDCVNTLFSLTGNNAQLAFREAQMTSVAYALRDNAANYPGDASTGTPQLVLYLRAGYYVQWYNPDVVGPYGPTLQTAIRSGLDGFFASSRSRDVTDANGETLSEAVILIDSAQENARYISVVKRMLADYNSTWNASSRMLAAVNNVYTVTFRGHQVPEFVSAVESDPSLIDSLHRFAADHLSLLEGDQAYLTSNAGRELGRFLQHTSLQSKVRPLATALLRDTSITGPTAPLWVGIAEMADYYDKANCATYGVCDLQERLKREVLPVRHTCSPSIRILAQQMTSAELSASCTSLIEQDAYFHRIAKDNGPVADDNNTTIEVIAYDSSADYQTYAGAMYGIDTNNGGMYLEGDPSVVGNQPRFIAYEAEWLRPDFHIWNLNHEYTHYLDGRFTMHGDFAANMTTPTIWWVEGFAEYISYHYREEPYTAAMTEAGKGTYALSTLFSTDYSHDTTRVYRWGYLAVRYMLEKHPADMDKVLAHYRAGEWSAARTYLTSTVGTRYDSDWKTWLAACAAGDCGGGGQPGNRAPTAEFTAAVKDLTVTLTDRSTDADGTIASRSWDFGDSTTSTQTSPAKTYSAAGDYTVRLTVTDDKGATATTSRTVTVTGGSTVGECTASDTRVLGKNCRRGNLSATTGNYAYHYLYVPAGTKTLKITVSGGTGDADLYYSNANWATTGAHTNRATGAGNSHTLTISNPPSGANYISLHAAAAFSGATVTTEY

SEQ ID NO: 44258 - protein, 326 aa, Streptomyces sp. W007
MAASIGALLSAGVATGAHAGTTEEPSAPAAAPAYQPEMVKALATTLGVSEKAAAERLDREADQQDRFAELREDRVSTLGAFFAKDGSLVVNAADAGAAKEVRAAGLKARVPERGESELDRIKAQLDAKALKSAPAGVSAWSVDLASDTVTVEVNGDSDAATRSFLKAAKSNGDAVRVVKGQEKLETQAVVPPGSRMTFNGYLCSVGYGAKDRNGKQVLVTAGHCIEDLPELAYNGTRFAKGTHTRFALGTRSVDMGIAAVDAGNSIGLDVTTYGRAGTVPVKGSKRAPPARRSASPARPPTGPAARSARTTSASPTPTRTAARTPS

SEQ ID NO: 44259 - protein, 294 aa, Streptomyces sp. W007
MIRRVMSLLVALGALVAALVVLPAATAQAATCATAWNSSSVYTNGGAVSYNGRNYTAKWWTQNERPGTSDVWADKGACGTGGENPGENNGFVVSEAQFNQMFPNRNAFYTYKGLTDALSAYPAFANTGSDEVKKREAAAFLANVSHETGGLFYIKEVNEANYPHYCDATQSYGCPAGQAAYYGRGPIQLSWNFNYKAAGDALGINLLANPYLVEQDAAVAWKTGLWYWNTQNGPGTMTPHNAIVNNAGFGETIRSINGALECNGGNPAQVQSRINKFTQFTQILGTTTGPNLSC

SEQ ID NO: 44260 - protein, 808 aa, Streptomyces sp. W007
MTSAWSRRTFLATSAALTAAGGGALTLAAPGAASAASAASAEADPYAALRTIWSTLILGEGFSPTAEPFKSRLADLGVKASRWLETMAPAEGSLWPDAVFADPDPDTDAESYVLSGRMADSFIRLNTMAQAYRQQGTGLTGNAGLRDAVLTGLEHLNTQVYNDGQVRYGNWYSWQIGAPQALLDVCVLMYDAIAPERRARYCAAVDHFVPDSAVASYTGTSTGANRVDLCRVLALRGVVGGSTAKIALARDALSPVFPLVTKGDGLYADGSFIQHTTVPYTGSYGSVMLGGLGLLFALLKGSAWEVTDPERQVVFDAVENAWAPFLFNGLVMDSVAGRAISRGEVDDHRRGHPILASVVLLGRGASAAENARWRALVKGWAQRDYYSPPLSNPSLGLTALARLKSVLDDTSVTPVPEPDGHRLFPDMARATHRRPGWAASLSMADRRITYYEVGNGENLRGWHTGSGMLYWWGDAFANGQYSDAFWPTVDPYRLPGTTASRKVLADGAGGDWGTSLPDVNWVGGVTDKKRAAVGQYLKGLSSTLMAKKSWFFVDDTVVCLGAGIHSRDGAAVETTVDNRNLGPTGNAPFTVGGSLKPLTFPWSATLTGTSWAHLAGHGGYVFPGGATVKALREDRTGRWRDINTAGSTDPVSRKYLTLWFDHGQDPSDATYAYQLLPGASEQRTAARAADGGWLRVLANTDDQQGVAVDSLGLTAVNFWFGGSVGPLVADAPCSVMVTEHADGTATVCVSDPMRMRTSLTLTWNRAVASVVSKPATVTSATAGASLRLVFGNLSGTRGATQTIKVRLS

SEQ ID NO: 44261 - protein, 786 aa, Streptomyces sp. W007
MLSPTRARATLLAAGAAVAGLLMSSLAAGPSVAADQTSCRPDGLYQTPGVDVPYCSVYDADGREKMGADHKRRVIGYFTNWRTGKDGKDAYLVPDIPWDKVTHLNYAFAHVDGSNKLSVGPDSADNASTGMTWPGVAGAEMDPTLPYKGHFNLLTKYKKQHPNVKTLVSVGGWAETGGYFGPDGKRVDSGGFYSMATNADGSVNQTGINTFADSAVDFIKKYGFNGVDIDYEYATTMKDAGNPLDHTLSNGRRAGLVKGYDALMKTLREKLDRAGAADGKHYLLTVAAPSSGYLLRGMETYQMQKYLDYVNIMSYDLHGAWNEYVGPNASLFDDGKDAELAQASVYSTSQYGGTGYLNTDWAYHYFRGSMPAGRINIGLPYYTRGFKNVQGGTDGLWGKAATTDCPAGAGLTKCGDGAVGIDNLWHDKDTNGKESPAGSNPMWHAKNLEKGIVGDYVTDYGFPANTQLTGTYVRKYDSTLVAPWLWNAQKKVFLSTEDEQSVKAKADYVVDKGIGGTMIWELAGDYQWNAAKGQYETGSTLTTAMYDAFKSATPYGAKRSTIDLPTQAVNIDVSFGQFPLGDSNYPISPKLKITNRTQATLPGGTEFQFDYSTSAPANAKDQSGFGTTIIRSDHTAANNIGGLKGDYNRVSLKLPAWQTLAPGASVELDFVYYLPTSTPSNWTVTFGGKSYSLAGDLARGTTVVEPGTGTGPTPTPTPDPTGPTPTPTPTQPGGTCPAPAWNAATEYGGGTTVSHGGHQWKASWWTKGETPGSAGQWGAWKDLGAC

SEQ ID NO: 44262 - protein, 355 aa, Streptomyces sp. W007
MRRNSRARLGVSLLLVAGALGLGAAPSTAADTPAAAPSAIPAPSAYALDAAVERQLGAATAGTYLDAKTGNLVVTVTTDRAEEQARAAGATVRRVARSAARLDAAMETLEAEAKITGTSWGVDPRTNRVAVEADSSVSARDMTRLEAVAERLDGAVDIKRVPGVFHREVLGGGAIYGGGSRCSAAFNVTKGGARYFVTAGHCTNISANWSASSGGSVVGVREGTSFPTNDYGIVRYTDGSSPAGTVDLYNGSTQDISSAANAVVGQAIKKSGSTTKVTSGTVTAVNVTVNYGDGPVYNMVRTTACSAGGDSGGAHFAGSVALGIHSGSSGCSGTAGSAIHQPVTEALSAYGVTVY

SEQ ID NO: 44263 - protein, 683 aa, Streptomyces sp. W007
MRVALAMALTAVPAVVALNTGQAAVASGLDDPVKKEIAMQIVSTAENSSLQWREQFDYIEDIGDGRGYTAGIIGFCSGTHDMLELVEYYTGKVPGNPLAKYLPALRAVDGSDSHEGLDPGFTSAWEQAAATPEFRAAQEHERDRVYFDPSVSRAKSDGLRVLGQFAYYDAIVMHGQSGFDSIRAEARNDARTPAEGGDETQYLDAFLDARVVEMKKEAAHEDTSRVDTAQRVFLRNGNLDLDTPLAWAVYGEDFRIDTDPRPDPEPTDTSGAETLISRGKPATASSSETSALAPGKAVDGDATTRWASAEGSDPQWLSIDLGAGASVSRVELSWEAAYAKQYRLEISADGTDWIRLAAETAGNGGTDTWTGLTGKGRYLRVYGTARGTTYGYSLWEADVYGTAGGTTPTDPPPKGAFTVVGAGDIADQCNESDPGCQHFKTAARAMAIDPAFYITMGDNQYDDAHIEDFRNYYDKSWGRFKDKTHPVPGNHEAYDDWDNQDEVAYRQYFGDRATPQGKMWYSYDYGSWHFVALNSNRFDEREQLDWLKADLAKNSKKCVAAYFHHPLFSSGSHGNDPVSKPIWSMLQAAGTELVLSGHDHHYERFAPQSPDGQADPNGIVEILGGMGGKDLYGQGDTVQKNSQKRIWDKFGVMQLDFTDTTFTSKFVGTDGTVLDTGPTYSCH

SEQ ID NO: 44264 - protein, 426 aa, Streptomyces sp. W007
MPSIDVVVAREILDSRGNPTVEVEVGLDDGSTGRAAVPSGASTGAFEAIELRDGDPNRYMGKGVEKAVLAVIEQIGPELVGYDATEQRLIDQAMFDLDATENKASLGANAILGVSLAVAHAASEASDLPLFRYLGGPNAHLLPVPMMNILNGGSHADSNVDVQEFMIAPIGAESFSEALRWGAEVYHTLKKVLKTKGLSTGLGDEGGFAPNLESNRAALDLIVEAIKEAGYVPGRDIALALDVAASEFYKDGVYEFEGKSRSAAEMTEYYEELVSAYPLVSIEDPLYEDDWAGWKVITDRIGAKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAVYAGRSAFPRFKG

SEQ ID NO: 44265 - protein, 234 aa, Streptomyces sp. W007
MLLNSKGKHRRPSKATRIATLAGVTGAAIAVPLMGATSASAASVETWDAVAQCESGGNWSINTGNGYYGGLQFSQSSWAAAGGTQYASRADLASKDQQIATAEKLLDLQGPGAWACAGAGGLTNDGVDPGVNTGSGSGESKPEQAQPERQAEQPTTRSEQREAPKAESKKTVTTPTGEKVQKGDGEYKVKAGDTLSTIAEAEGVKGGWSKLFELNDDIVKDADLIFPGQQLHLK

SEQ ID NO: 44266 - protein, 349 aa, Streptomyces sp. W007
MGSANGRHRRPRQAPAIIVAAGVTGSAIAIPLLGAGGAQAAEATTWDRVAECESGGMWSADLGNGYYGGLQFSQETWSAYGGTAFAPRADLASRSQQISVAEKVLDDQGPKAWPSCAVISGLAVDGSLPGVDPGTSPSADPSADPSADPSADPTSTPTDEAGESGKSEKGEKGDEADKGGRGDTEKGSEAPDSSVTPTAPPASDAPDTSDPSTAPDASKGEDGKGGKHRGAPAPEEADAGQEDGPRESGRHASRGDGDARDGGAATAGEYTVQPGDNLWAIADAQEIPGGWTGLYETNKGLLGSDPDLILPGQNLDLGLDPSADKAADKAADKSADRAAPEGAEAPAAN

SEQ ID NO: 44267 - protein, 489 aa, Streptomyces sp. W007
MPVAPSTVRPTGSRHDAPRGPARGRWLRGTAVAAAVLTAWTAAPSAAAPLPPEAVRPGHCSGVELIRVPGAAHQQADCLEELTTAGTVASGHTDPADWAGLTPKDLATPSGVPGIQIDGYFPDTSTGNTNHGWNHDSQFVIRLPDRWNGGLVVAGSPGVREQYANDRAFGDWALARGYAYAATDKGNTSAAFHRDGTAPGDAIAEWNTRVTQLTRAARLVVARRYHRLPSRTLAMGMSNGGYLVRWQLENHPGLYDGGVDWEGALWHADGPNLLTFLPPALRAYPRYAAGGADAEDAHRTMTAAGYPAGSEFLWPYHHQYYWDLTQRIYREEIDPEFDGAAEAGTPFCAPGTPACDADYDYAGRPAEVRDAVAGIALTGRIGKPLISFHGTLDVLLPISRTSDAYARMVRREGRGALHRYYRVEGGTHVDSLVDTFPDRLRPLVPCHRSAAAALERWLDDGRRPPSSRTLELPEGAGPAELLGRCPLDG

SEQ ID NO: 44268 - protein, 436 aa, Streptomyces sp. W007
MPYVMPSHPAPPGAPPPRTGRGGRWSHGVRRLAAVVALVTGAALAGPGTAGAAPAEPMADGARTAAALERVTAFGANPGNLNMYVHRPPALPANAPVVVALHGCTQSAQVYSDNSGLDTFADRHGFLVVYAETTTANNANKCFNWFQPGDTRRGQGEAASIRQMVAHAATAYGTDVDQVHVTGLSAGGAMTSVMLAAYPEVFAAGAVVAGIPYGCGVDVVSAFGCMSPGTDRTPAAWAQAVRDAHPGFTGPWPRVAIWHGDNDPTVVPRNADELRDQWTAVHGLGQSPDRTSTVGPNSTRRSEYLSAGGGSVVEVNRVPGIAHGTPVDPGTGGEQCGATGTQHFIDSICSSHWITRFFGLDGSTAPEPPVDPPTEPTACWTADNYEHVRAGRATTTGGHVYAKGSGLHLGLYNTFVTHTLKESPAGHYVLADGTCP

SEQ ID NO: 44269 - protein, 273 aa, Streptomyces sp. W007
MKHTVQALRLPLAVSLLTAAALSGCSGTAPGIPDVGLNDPAKKRIAMRLVSSAENSSLDWEAQYPYIEDIGDGRGYTAGIIGFCSGTGDMTEVVERYAKARPGNPLERFLPALRAVEGSDAHTGLGKPFTRAWAKAAEDPAFRAAQEAERDAVYFGPAVRQAEEDGLGALGQFIYYDAYVMHGAGDTEGTVGFRTMRREAMAASRTPARGGDEKAYLNAFLDARVAAMVEEPAHSDTSRVETAQRVFVREGKLRLETPLRWKVYGDAYRIEKG

SEQ ID NO: 44270 - protein, 217 aa, Streptomyces sp. W007
MRHLRTAVATAAAGLGLVAALGTAPVVAAAPAPAAPSSTTIAAYNGSGENAAANRAFLDAVMKSVAEKRAANPGIKAVTVTYNASSAPSFRGEIANSTQIWNSSVSNVRLQEGSNADFTYREGNDPRGSYASTDGHGRGYIFLDYAQNQQYDSTRVTTHETGHVLGLPDTYSGPCSQLMSGGGPGPSCTNANPDANERARVNQLWQNGLAALARSAS

SEQ ID NO: 44271 - protein, 809 aa, Streptomyces sp. W007
MRGDMTNRDTTRRTVLTGAAALGVAATLPLALAGPAHAASGTARTAAEDAAALRTRWHTLLTGGPDLDRGDERIVAATARVGRAGATAATGLDPSRTDGLFPDLTSTTLSNHVTTSFKRLATAATAWAVPGTPQHGDAALLAKLLGGVDWMLTHRYGPEHTRFDNDWDWEIGAALALNDTAVLLHDQLGAERLERVTAAVHHYTPDPNLWRVNRQIATGANRVWVSTVVAVNAVLRGDGAALARVRDALSDVEGAGANSVLAFNDTGGAAAGTGEGFSSDGSFLQHYKHPYNGGYGKELLGNLSRLLNLLAGTAWTVTDPDLDNVRGWVDDGFDPLMFRGDVVASVCGREIARPSKQGHASAQTVIEAVLRLIPCFPGEPADRFTALVKQWIAEDGYRDFLAVTDLASLVAAQRAIASAVPARGPLVAHKQHPGMDKAAHHRPAFGLGISAYSTRIYNYESIQNENLRGWHLSDGMVLLYTDDLGHYSEDYWPTVDPTRLPGTTVLAGRPADAAGQRTTSTADWAGGTALPDTTLGAYGMELRAFGSTLHGLKSWFCLDDVIACVGSGITAEAGTAETVVENRKLRDPRAALLVNGSAAPDGPGWSDELADVRWLHLAGTGGYVFPRPASVRALREERTATWREINLKYGTDTPVTRPYLTLWHDHGPAPSGAGYFYLQLPTASAGRTRLLSAAPPVELIADSTAVHAVRRGADGLLAANFWRAGTARELSCDGPASVLVRPRGRNVSVALSDPTQLRSTVVVELAGRGLTLASGGPRVSAARTPGGIRITADTSGLRGTTLDLTLKRS

SEQ ID NO: 44272 - protein, 434 aa, Streptomyces sp. W007
MAPKAVEPTVIQSVTARRIIDSRGNPTVEADVRLADGSLGRAAVPSGASTGAREAVELRDGDAGQWHGKGVDRAVAHVNDEIAAAVVGRYADDQAGLDAALVALDGTPGKSRLGANAILGVSLAAAKAAAAAHRQPLYRYLGGVDARLLPLPMMNIINGGAHADNPLDFQEFMIAPVGAKTFAEAVRMGSEIFHTLRRDLLAAGHATGVGDEGGFAPALRTAEEALDFVLSAVERTGYRPGEDIGLIMDPASSEFFRDGTYVYAGEGVRRTPSEQVDYLVKLIDSYPVVSIEDPMAEDDMDGWRELTARVGQRCQLTGDDVFCTDEAQVREGIRTGVGNSVLVKVNQIGTLTEALATVATARRAGWSAVMSHRSGETEDTTIADLAVATGCGQIKTGSLSRSDRTAKYNQLIRIEEELGESARYAGGALLSRSR

SEQ ID NO: 44273 - protein, 208 aa, Streptomyces sp. W007
MKALIRRALVSAASVAVVGTLAVGCSTEPKPDKPASIAATEPSDEAAAEEPVEPSPSASTTPAIKVGESGTFDFYETDEYGQNPEVSTQLEVTVKSAKYVTPAEIDTTNEPENGQFVKLTITVKNVGKAPGEFAAYGMMTWENDDTAAQEATTLEGVGEGQDVDTTYKPGQSVTGSLILDVGAKGGTLSYASSIVDEASAFTIELPKA

SEQ ID NO: 44274 - protein, 300 aa, Streptomyces sp. YG-2000
MRIKRTTPTSGIARRTRLIAVATGFVAAAAIAVPNANASDVHTFSANQLTKASDSVLNSDVAGTAWAVDPATNRVVVTVDSTVSKAEIAKIKKTAGSNAGALTIKHTPGKFNKLISGGDAIYASSWRCSLGFNVQDSSGNYYFLTAGHCTDGAGTWWSNSSHTTTLGTTAGSSFPGNDYGIVRYTNSSVAKSGAVGSQDITSAATPSVGTTVYRRGSTTGTHSGRVTALNATVNYGNGEIVYGLIQTTVCAEPGDSGGPLYGGSTAYGLTSGGSGNCTSGGTTFFQPVTEALSAYGVHVY

SEQ ID NO: 44275 - protein, 444 aa, Streptomyces subtropicus
MPRHAPTEGPRMSRTTAEPTAIRSVTARRIIDSRGNPTVEVDVRLADGSLGRAAVPSGASTGAREAVELRDGDAGQWHGKGVDRAVGHVNGEIAAAVVGRDADDQAGLDAALIALDGTPGKSRLGANAVLGVSLAAAKAAAAAHRQPLYRYLGGADARLLPLPMMNIINGGAHADNPLDFQEFMIAPVGAKTFAEAVRMGSEIFHTLRRDLLAAGHSTGVGDEGGFAPALRTAEEALDFVLSAVERTGYRPGEDIGLIMDPASSEFFREGAYVYTGEGVRRTPSEQADYLAKLIDAYPVVSIEDPMAEDDLDGWRELTARVGHRCQLTGDDVFCTDEAQVREGIRTGVGNSVLVKVNQIGTLTEALATVATARRAGWSAVMSHRSGETEDTTIADLAVATGCGQIKTGSLSRSDRTAKYNQLIRIEEELGESAQYAGGALLSRS

SEQ ID NO: 44276 - protein, 470 aa, Streptomyces sviceus ATCC 29083
MWARSGPLERVVVSNSQYETYEAYETYGPPEPYEPSAYGGPDAPPTGPDTARTLDYGVYGAPDMARTRPYEDTYRPAYEMPESPLPRQAAVGRRAARRRRTRYAERPDSAMRRLLPQALVVAFLAGGTTAFVAKDKAIELTVDGKPRTLHTFADDVTELLAEEGVAVGAHDVVAPAPGEQLASGDEVAVRYGRPLRLTLDGHQREVWTTARTVDGALEQLGVRAQGAYVSTSRSRPIGREGLALDVRTERSVTVMADGRARTIRTNAATVAEAVEGAGVTLSGMDTTSVAPGSFPREGQTVTVLRITGSKEVREELIPFREERSEDASLFKGTEVVDQAGTPGVRRVTYSLRTVNGVRQKPRRIRVETVREPRTQIVRVGTKPRPTSVQGADHLNWQGLAHCESGGRPNAVDPSGTYGGLYQFDTRTWQALGGSGRPQDAPAVEQTFRAKKLYVRRGASPWPHCGARLHG

SEQ ID NO: 44277 - protein, 771 aa, Streptomyces sviceus ATCC 29083
MNPQRRASVRPTRRAVLLAAALLAAAAPPARARSLSADPYDTLRRRWIDIALGTGYDPAAEPYASRLAETGELARGFRAAMAPTSTSLWPGLPYDPPAGITRSYSRLWTMTQAHVQQGTGSTGDESLLADVLRGLDHLSATVYNPSTTRYGNWWEWQIGSPRLLMDVTAALHDHLTDAQRAAACAAVDHFIPDAMLTDYSGTSTGANRVDLCRSVALRGILGRAPDRIALARDALSPVFPYVTKGDGLYADGSFVQHTWVAYSGTYGQVMLDGLGRLFALLAGSEWEVTDPNRQTVLDSVERAYAPLIHDGLVMDSVNGRAISRGHLKGDDRHVLRGDHFHGQGIIAAIALLAGGASEQERTRWHGLVKGWIERDTVSPVLTAPQFGVADLARLHTVAASPVPAAPEPVGHTLFAAMDRAVHRRPGFVANIAMASDRIAAYECGNGENPRGWHTGAGMLSWWAKGHGEQYTDWYWPTVDWYRLPGTTVSTKRLPDRAGGEWGEPKPDVRWVGGTTDGEYAAIGQHLKGLGSTLEARKSWFCVDDSVICLGAGITCADGVPVETVVDNRNLGEGGTQSFVRGRGWAHLEGHGGWLVPDGVRALREDRTGAWSDINTSSTTERRTRRWQTLWLDHGTDPVDASYAYVLMPGASRRTVAARAADRHWLSVLANDSAWQAVRVDRLGLTAANFWRAGTAGPLTASAAASVLVRRSGRTATLCVAEPPRSGETAGDRLESARAVGRAGRRHGRGACHRPPAAPARHSGDGMRHPPM

SEQ ID NO: 44278 - protein, 269 aa, Streptomyces sviceus ATCC 29083
MAFPSGAAARRTLLAALGAGVLSSRRPSTEAGDPTGLDDPVKKDLAMRLVSSAENSSLDWQAQYTYIEDIGDGRGYTAGIIGFCSGTSDMLALVELYTERVPANPLAPYLPALRAVDGTDSHDGLDPGFPAAWRTAAKTSAFRTAQRDERDRGYFDPAVARAKKDGLGTLGQFVYYDAMVMHGPGADALSFGGIRGRARQGADTPADGGDQTAYLHAFLDARVWAMRQEAAHHDVSRVETAQRVFLEQGNLDLDTPLNWKVYGDSYEIG

SEQ ID NO: 44279 - protein, 704 aa, Streptomyces sviceus ATCC 29083
MEDPRPAVRGVLRLGPSDTGVLGEVSGYVREVPSRARRRGGGLGSRTARLSRSVGGLMQGVDPAWLPDGAFRPIGTRRTLIRGSGPLVDTVHGEVAEACERFGGSVSRAPEPCDLVLELTGDDGSEGFVLGRRDGCTTVTASGARGLLYGLFHVVRLGEAAFLGETQPAVHEPKLALRMLDHWDNVAVHPVMGQVERGYAGGSLFWEDGRARGDLDRVRRYGRLLAACGINAVSVNNVNVHAAEARLLTERLGEVADIAGALRPYGIRVHLSVTFAAPMVLGGLPTADPLDPGVSAWWAEATARVYAAVPDFGGFVVKADSEGQPGPFAYGRTHADGANMLAAAVEPYGGTVHWRAFVYDHRQDWRDRSTDRARAAYDHFVPLDGEFADNAVLQVKHGPMDFQVREPVSPLIGAMPGTRLAVELQATQEYTGQQRHVCWLGPMWSEVLRFRIDGESTVGASARGGLVAVSNVGDDPFWTGHPLAQANLYTFGRLAWEPGGDPHRFLDEWIGLTFGSAPGLAKGLRSILDGSWRTYEKYTAPLGVGFMVQPGHHYGPSVDGYEYSPWGTYHFADRDGVGVDRSVASGTGYAGQYAKPWAEVYESAETCPDELLLFFHHVSYGHTLHSGKTVIQHIYDTHFEGVAEVEAAQEVWASLADLVDPARHTRVTERFEEQLRSAREWRDQVNSYFFRKSGVPDARGRTIH

SEQ ID NO: 44280 - protein, 201 aa, Streptomyces sviceus ATCC 29083
MPLGTWLKAGTSATALVLAMAGAATAAPAPAPAPAPAPAGESSAAQAAAVTLRYDDSRAAGWEAAIAAGVASWNANVSNVHLVEAASGTVAEIVIVATTGWPQATLGPVRPGRQVRVELGSQAVDQGYNKTRIAAHELGHSLGLPDTKPGPCSQLMSGSSAGTACTNATPNATERSRVQSAYASGIAALAPADGRMLIDAP

SEQ ID NO: 44281 - protein, 325 aa, Streptomyces sviceus ATCC 29083
MLSGNGRHRRPRQAPALLVAAGVTGSAIAIPLLGATGASAATGTTWDRVAECESGGSWSANDGNGYYGGLQMSQENWEKYGGLEYAETADLASRNQQIAVAEKLLADQGIAAWPTCGLLNGLSKNSGSADVDTGVGSGAPSASTSGSSDSSGSSGSSNSAGSEESSGLLDALDGSSATPSPSASASSGDSSAKPDKKNSSGSGGSAAKETQPSDGSPVVSAEEDEADKSWQEGSSSALVDVGALGSGKHRGDSAQESATKSTASASAGRHAAATYVVQEGDSLVSIADSLGLDGGWRALYAENKDRIGVDPSNIVAGQTLDTGAE

SEQ ID NO: 44282 - protein, 230 aa, Streptomyces sviceus ATCC 29083
MLFSGKGKHRRPSKTTRAAALAGVTGVAIAAPLMAAGNASAATASEWDTVAQCESGGNWSINTGNGYYGGLQFSASTWAAYGGTQYASQANQASKSQQIAVAEKVLASQGKGAWPVCGKGLSGASYSGSSSSSSSSNSSSSNSGTSTRSTGEQSASRSSERPAAKKTVTTPTGKKVKKGDGEYKVVKGDTLSSIAEKHKVKGGWQKLFKLNKDIIDDADFIFPGQQLHLK

SEQ ID NO: 44283 - protein, 428 aa, Streptomyces sviceus ATCC 29083
MLVPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGTEVYHTLKKVLKSKGLSTGLGDEGGFAPNLESNRAALDLILEAIKEAGYIPGEQVALALDVAASEFYKDGKYQFEGKDRSAAEMTEYYEELVAAYPLVSIEDPLFEDDWAGWKVLTDKLGDKVQIVGDDLFVTNPERLARGIEDGAANALLVKVNQIGSLTETLDAVELAQRSGFKCMMSHRSGETEDVTIADLAVATNCGQIKTGAPARSERVAKYNQLLRIEEILDDAAVYAGRSAFPRFKG

SEQ ID NO: 44284 - protein, 230 aa, Streptomyces sviceus ATCC 29083
MSYPKRTAALASLAALAGSAVLMAAPAARAAVVNVNYQCKTPIGDKSAVSPIDIKGVKSGSGYKITMSWQKGVSSSPVDLGKGAMNPSATIKLGGADSGTMSVTGPANQAVVPANTPIKINDLTGTYTPKKSGKVTFTAGVLTIKALGTTTTCTPTSSPGASLTLNVTAASGSSGGTRSDSGSDSADALPQTGPEDSAIALGTLGGTVLLAGAAGTLWLTRRNQAARVRR

SEQ ID NO: 44285 - protein, 214 aa, Streptomyces sviceus ATCC 29083
MSECAHTSRDNVRKTRTTVALAGAALLAPLGLLAAAGNSVAADGGVWDRIAQCESGGNWHINTGNGYYGGLQFSAGTWRAYGGTAYAATADQATKSQQIAVATKVQGAQGWGAWPTCSARAGAYGNAPAASSGPAGTSSGTTKAAPAEPAKTPTRAENHADRSVSRGDYTVRPGDTLSKVAARHGTTWQKLYAVNKAVIGTDPDMIVPGQRLDI

SEQ ID NO: 44286 - protein, 302 aa, Streptomyces sviceus ATCC 29083
MRIKRTNPRSGITRRTRLIAGTTGLVAAAAIAVPSANATAATPFSTAELKSASSSVLKADIPGTAWAVDSKTNRVVVTVDSTVSQAEIAKIKEQAGSNADALTIKHTPGKFNKLISGGDAIYASSWRCSLGFNVRSGSTYYFLTAGHCTDGAGTWWSNSGHTTTLGSTAGSSFPTNDYGLVKYSSSYPVSSISGTVGSVDITSAATPSVNTTVYRRGSTTGIHSGRVTALNATVNYGGGDIVYGMIQTTVCAEPGDSGGPLYSNSGIAYGLTSGGSGNCSSGGTTFFQPVTEALSAYGVSVF

SEQ ID NO: 44287 - protein, 391 aa, Streptomyces sviceus ATCC 29083
MGFGRVRARQPAFRPARSPQSQGRPPTGGPELKHRRIPRRRIVVAGAGITALVAAGVTLQTANASETPASPQVKTLSAVAAGKLASTLGTELGADAAGTFYDAKTKSLVVNVLDEDAARTVSAAGATARVVSNSLAELKSARTTLVDDATVPGTSWVTDPTTNKVVVTADRTVSAAEWAKLAKVVDGLGSVAELQRTKGEFTPFVAGGDAISGSGGRCSLGFNVVKGGQPYFLTAGHCTEAISTWSDSSGNKIGTNEVSSFPDNDFGLVKYTASVDHPSEVNLYNGSAQAITGAASATVGQSVTRSGSTTQVHSGKVTGLDATVNYGNGDIVNGLIQTDVCAEPGDSGGSLFSGSSAIGLTSGGSGDCTSGGETFFQPVTEALSATGASIG

SEQ ID NO: 44288 - protein, 377 aa, Streptomyces sviceus ATCC 29083
MAVRGRHRRYQPNRINRASLTVTAGGVGIAVPLIGTGTAHAADMATWNKVAACESSSNWSINTGNGYYGGLQFTRSTWEAYGGTRYAARADLATKDQQIAVAEKVLDGQGPGAWPACSSRAGLTRGGPTPDLHPRTEKTAAKTSSVRDVQPQTTPQSRAGRAEMYTVVHGDSLSGIADAQKVRGGWRGLYAANRETVGADPDLILPGQRLKLRGSAATPATTHHAPTKKTSSHTGKKTEKATDTGLVAPVNASLGTPYRKAGSAWSKGYHTGVDFPVPTGTSVKAVAAGKVVTSGWGGSFGYQVVIRHSDGRYTQYGHLSAISVKAGQSVGGGQRIGRSGSTGNSSGPHLHFEVRTGPGFGSDIDPLAYLRANGVRI

SEQ ID NO: 44289 - protein, 454 aa, Streptomyces sviceus ATCC 29083
MAHRHVSAGCAALTVLGALVLTGLPAAAAAEPPAPTPAPSAAETLGANSPSSVVLRAMERDLRLTEAQARTRLVNEAEAGTRAGRLQNALGKRFAGAWVSGATSADLTVASTDVADTPAIEAGGARAVVVDTPLADLRAAKTKLDRAVTGEGLKTPVRYVDVRTNRVTLQATSRAAADTLIEAAGVDSALVKVKVSADQPRALYDIKGGDAFYIDDTFRCSVGFGVTKGDQQGFATAGHCGKTGSKTTGFNQVAQGTFEASVFPGQDMSWVGVNSDWTATPAVKGEGGQDVQTAGSVQALVGAAVCRSGSTTGWHCGTIQQHDTSVTYAEGTVDGVTRTTVCAEPGDSGGSYISGVQAQGVTSGGSGDCTSGGTTFYQPINPVLSTYGLTLKTSTSESGTSAPEDGQEGSWAAGRVYEVGERVTVDGVAYECLQPHQAQAEWQPALAPGLWQRV

SEQ ID NO: 44290 - protein, 436 aa, Streptomyces sviceus ATCC 29083
MRTHGHPGAPNNRLPYGGYRLRSPRRSRSLSHKRIPKRKAAFAAGTVVALGAAAILLPNANASQDGSSNNATAIAPKTLKATDASDLASQLEKLLGDAFAGSYYDSDSKQLVVNVISGDSNVVVQAKKAGAKVRQVDNSLPELAAGAKTLKEEATIPGTAWAVDPRTNKILVTADSTVTGDKWNTLESTVKSLGSDMATVKKSAGTFKTFVSGGDAIFGGGARCSLGFNVTAGDGSPAFLTAGHCGVAAKQWSDTQDGQPIATVDQATFPGDGDFALVKYDDPATQAPSEVNVGGGQTVAISQAADAEVGLQVFRMGSTTGLADGQVLGLDATVNYPEGTVTGLIQTDVCAEPGDSGGSLFTQDGSAIGLTSGGSGDCTVGGETFFQPVTTALQAVGATLGAGDAAGGAGDAAGGAGDQAGGEEAGAGADASNEPR

SEQ ID NO: 44291 - protein, 142 aa, Streptomyces sviceus ATCC 29083
MRNTARWAATLGLTATAVCGPLTGAALAEPAAASSLYAPSALVLTLGHGESAATVTPERAVTLTCAPTSSGTHPAAAAACAELRAAGGDFDALGAGSDALCTREYKPVVVTVDGVWRGQRVSYERTFANECVKSSYGTLFAF

SEQ ID NO: 44292 - protein, 267 aa, Streptomyces sviceus ATCC 29083
MTSSARPRARTRALTGAAAALGLSVGMIMTLTAPTASAATWPTANGSQAVSSTIQLSGTKDYGMKRLYGTGDLGSDSQDEDQGPILNLAAGTVLKNVIIGAPAADGIHCAGSCTLQNVWWEDVGEDAATFRGSSSSNVYTVSGGGARSASDKVFQFNGAGTLNVSNFAVQNFGTFVRSCGNCSTQYKRTINLNTIEATYSGNKLVGINTNYGDSATLKKITIVGDSGKKIVPCQKYIGNNTGKEPTTNGSGPDSTYCKYATSDITYR

SEQ ID NO: 44293 - protein, 420 aa, Streptomyces sviceus ATCC 29083
MLAVVLSLLAAVLFAAVPTASARTQAVPTATLTEITNFGTNPSNLQMYLYVPDNVTAHPAVVVAVHYCTGSGPAMYNGTEWARLADTYGFVVVYPSVTRSSKCFDVSSPQALKRGGGSDPVGIKSMIDWTVNTYSADTGRIYATGISSGAMMTNVLLGDYPDVFAAGAAFSGVPFGCFATTDGSEWNSACSGGTIAHTPQQWGDLVRAAYPGYTGTRPRMQVWHGTNDDVLRYPNFGEEIKQWTNVLGVSQTPAVTDTPVSGWTRTRYGATGDRAPVEAISLQGVGHNLYTTGMAARALAFFGLDGSGPAPQPQPGACKVTATTNAWSTGLTASLTITNTGTTAINGWQLAFTLPTGQTITNGWGATYSPSSGAVTGTNATYNGTIAPNASVSIGYQANHGGNSAAPGAFALNGKTCTAS

SEQ ID NO: 44294 - protein, 456 aa, Streptomyces sviceus ATCC 29083
MRHARRRVVRRVTRLAAVGGLLLGGAMVTRAVASEPPATTAVPRTYAMEAGRTGEDLVSRLGSSRTAGTWIGADGKPVVAVTDEQAAAEVREAGARPKVVGHSMDELKSAARTLRSAPRVAGTAWSMDYRTNEVVVQGDSTVSASDWAAMTKVAHGIGGFVRMERTEGSFTPRLNGAQPILSTGGRCSAGFNVTNGQSDFILTAGHCGPTGSTWFADTGGTNQLGKTVTQSFPGNDFSLVQYNNGKAGDGAGVVFIGNGKGVQITGAGDPSIGQRVFRSGSTSGLRDGQVTGVNSTVNYPEGTVTGLIETNVCAEPGDSGGPMFSEGIALGITSGGSGDCTQGGTTFFQPVTKALTALGMRLIVSNPTAAAGGASPAPSATSAQGSIAPGAASPGSSAAVQGAQGTPLLSRLTDTRNVGPGLLVLGGSLIALVATRYIRSEQDRRAYQRYYGATWG

SEQ ID NO: 44295 - protein, 299 aa, Streptomyces sviceus ATCC 29083
MSRARRTDIRRPRLIAAVVSLLVVTALSVSDTAAAAAPPASSAPSTTSVSGAASVVASLGIAGTTWTVDGRTGKLRISADSTVADPDLSRIRQATGRFPGAATVERLDGRLRTLVSGGDGIHASAWRCSAGVNVRGGSTYYFVTAGHCTEAMPTWYTSSALTTEIGPTTGTSFPGDDFGVVRYANPAVPHPGTIGTVDVTGTATAYVGQSVCRRGATTGVRCGTVTALNATVNYGDGSTVSGLIRTNICAEPGDSGGPLYAGDKVLGILSGGSGNCATGGTTYYQPIQEALNAYGLSVY

SEQ ID NO: 44296 - protein, 380 aa, Streptomyces sviceus ATCC 29083
MRRNPLLRAGLAVLLLLGAGATAGTVPAAADEKQPASAGLLTAMQRDFGLTPEQAVARLAAERKATALQPKVRRAAGTSFGGSWFEAAQGTLTVAVTPGTSATALREIRATGATVRTVAHSARELSATQARLDALPAPDAVSSWHVDPKASTVVVNVVSGRQRDNDVQAFVARARKAGPVTVREVAAAPTTFAAGTVGGDPFYTGNVRCSIGFSVYGGFVTAGHCDQHTGSVYGWDRSYVGNFQGSSFPDNDYAWVNVGSGWWTVPVVLGWGTVSDQLVRGSNVAPVGASICRSGSTTHWHCGTVLAMNETVNYSQGAVHQMTKTNVCAEPGDSGGSFISGDQAQGVTSGGWGNCSSGGETWFQPVNEILNRYGLTLHTA

SEQ ID NO: 44297 - protein, 193 aa, Streptomyces sviceus ATCC 29083
MAEISDGAVTFDSNADAAQYGAKHWNDYAESLPDEQKAAVHDYTGPEHHRINGFLREGEGGYYDSPQVRRHVEQLDKALAGNALPEDVVVRRGTGLEHYLEKMRSAHPADMIGKKFTDDAYMSTSLGDAVFTNKDAVLHLRVAEGTPGLYVEKVGRYGADERELLLGRGNEYTVTEAFKDANGQWQIYGKIHR

SEQ ID NO: 44298 - protein, 272 aa, Streptomyces sviceus ATCC 29083
MHPAAHPSRRTLLALMGAATCAGMLGSVPAAAASAAAPGLDDPAKKEIAMKLVSSAENSSLDWKAQYRYIEDIGDGRGYTAGIIGFCSGTGDMLDLVQLYTDRKPGNVLARYLPALRRVNGTDSHSGLDPNFPADWRKAAQDTAFQQAQNDERDRVYFNPAVRQGKTDGLRALGQFAYYDAIVMHGDGGDATSFSSIRRRALRQAKPPAQGGNETTYLNAFLDARVWAMKQEEAHSDTSRVDTAQRVFLRQGNLDLNPPLDWKVYGDSYHIG

SEQ ID NO: 44299 - protein, 267 aa, Streptomyces thermocarboxydus
MTSATRPRTPRRALTGTLATLGLSVGMILTTAAPSAQAATWPTPNGSQGVSSTISVSGTKDYGMKRLYGTGDLGSGSQDEDQGPILKLSDGAVLKNVIIGAPAADGIHCEGSCTLQNVWWEDVGEDAATFKGKSSGAVYTVSGGGAKEASDKVFQFNGAGTLNVSNFAVQNFGTFVRSCGNCSSQYKRTINLNSIEVTWKGGRIAGINTNYGDQATLRNITIVGDTSKKIVPCQKYIGNNTGKEPGSNGSGPDGTYCKYSSSDITYR

SEQ ID NO: 44300 - protein, 552 aa, Streptomyces tsukubaensis NRRL18488
MRSRKPLIAAMTTAALAAGVLAGFAATGNAATPQQTAATTPAQAGVKIAYYDQWSVYGNAFYPKHLDTRGIANKLDIINYSFGNIHPTDLTCFQANKAAGDDNNPNAGDGAGDSYADYQRTFSAADSIDGVADRWDQPIAGVFNQFKKLKAKYPHLKINISLGGWTFSKYFHDAAKTDAARKKLVASCIKQYITGDVPKADGYGGPGTAAGIFDGIDIDWEYPGSNGGHLGNHYGPEDKANFTLLLAEFRKQLDAYGTANGGKKYLLTAAMPAGQDKIKHIETDKVGAYLDYANIMTYDMHGAWNGTGPTYHQSPLYSPPSDPTTPIAPGTEKYSIDNSVRAWIDGNPAYGIAGGFPANKLTLGYEMYYRGWKNVPAGAKNGLGQTANGGSAPRPLSQAAGIANYKELGGIVDNPATTFWDDEAKAAYFYKNGEFFTGLDKRAIDARAAYAKSKGLGGAMMYSLIGLDEQTKLLNDVVAAVGESVRPSPTPTPTPTPTPTPACGEAWTATGVYNTNSVVSHNGRKWKAQWWTSGNEPGTGGEWGVWRDQGAC

SEQ ID NO: 44301 - protein, 236 aa, Streptomyces tsukubaensis NRRL18488
MLFSSKGKHRRPSKAARFAAFAGITTVAVAAPIMGATSASAATAAEWDKVAQCESGGNWSINTGNGYYGGVQFSSSTWAAFGGTKYAPNAHLATKAQQIEIAEKTLAGQGKGAWPKCGVGLSNTPYGGAAAEQAPAQPKQEQPKQQAQPAQPKQERAEVPTTRSERAQAPAPAKSAAPAKGFEKGDGEYEVKSGDTLSKIAEAEQVEGGWQKLFELNKDTVDDADVIFPGQQLHLG

SEQ ID NO: 44302 - protein, 426 aa, Streptomyces tsukubaensis NRRL18488
MPSIDVVVAREILDSRGNPTVEVEVGLDDGSTGRAAVPSGASTGAFEALELRDGDPNRYLGKGVEKAVLAVIEQIGPELVGYDATEQRLIDQAMFDLDATPDKSSLGANAILGVSLAVAHAASEASDLPLFRYLGGPNAHLLPVPMMNILNGGSHADSNVDIQEFMIAPIGAESFSEALRWGTEVYHTLKKVLKGRGLSTGLGDEGGFAPNLDSNRAALDLILEAIKEAGYTPGQDIALALDVAASEFYKDGAYHFEGKSLSAAELTSYYEELVAAYPLVSIEDPLFEDDWEGWKALTEKLGSKVQIVGDDLFVTNPERLGRGIEEGSANALLVKVNQIGSLTETLDAVELAQRNGFKCMMSHRSGETEDVTIADLAVATNCGQIKTGAPARSERVAKYNQLLRIEEILDDAAVYAGRSAFPRFKG

SEQ ID NO: 44303 - protein, 106 aa, Streptomyces tsukubaensis NRRL18488
MTGSAIAIPLLGATSASAADSATWDRVAECESAGQWTVNNLNGYYGGLQLSQETWNTYGGREYADRPDLASRSQQIAVAEKVLAAEGPKAWPSCGIASGLGGAAGT

SEQ ID NO: 44304 - protein, 304 aa, Streptomyces tsukubaensis NRRL18488
MAVGGHDIVAPGPAAALASGDEVVVRYGRPIALTLDGSRRTIWTTAETVEDALRQLGVRAEGAYLSASRSAGITRAGLALDVRTERAVTVLADGRARTLRTNAATVAQALAEAGIALHGEDTASVPLDAFPRDGQTITVLRITGSRQVREEPVPYGTVRTADPRAFAGTETVVQQGRPGTRRVTYALRTVNGVREKPRKVAEELVRRPVTQRIRYGTRPLPRSVAGTDGLNWSALARCESGGRPDAVDPSGTYGGLYQFDPFTWRSLGGRGRPQDAPASEQTFRAKKLYVQRGAAPWPHCGRRL

SEQ ID NO: 44305 - protein, 245 aa, Streptomyces tsukubaensis NRRL18488
MGVTALVLGIIGIILGLAVILFWLSWLPALLALIFGIIGVSHARKGTATNKGMALGGVIMGSAGLLLSIGGGLLTVFFVNEANDTAEDRILQIEASAEAEDREAKKKEAAAAAARKLSFGEPFLFENGLKVTVHKPKPYAPDSFASGHAKGNKAIEVTVTVLNTNKVRMSLESGLPTVYDTEGADTEMIIDASDRLKFMNDFVLPGKQAVGRYAFSLPPTAATTAEVEFNPSLADLDGARWSGSL

SEQ ID NO: 44306 - protein, 147 aa, Streptomyces tsukubaensis NRRL18488
MRPLSPRSLFVSAAALMLGVAGTAMSTAAAQPTAGAPALYAPSALVLTVGQGETRTKTTAERAVTLSCAPRATGTHPAAADACRELRAVGGDFRALPSELPQTLCTREWAPVTVTADGVWEGRRVAWSGTYNNSCEMAATLGIVFEF

SEQ ID NO: 44307 - protein, 1353 aa, Streptomyces tsukubaensis NRRL18488
MRAASVPTGQAVLLQNIRNGAQLGITATGGGNIAEARAPQGDNHNQAWVLERTPGGTYLLRNSELRNFCLVRDPEPLAGLCDEPGAPWDVQRIGDGEYWIKEPGADRYLTSSTEISKSEKQADLRMGTDGDDRGTWFMTPVDWPRQPMPPQDRRTLEHMTYLTAHNAMINKEDGYSTVAPNQPHSMERQLADGVRALMPDVNAQVVNGAIWLCHGGSCGGVPNPNNNLATMLGTLKTFLDANPSEIVSVFIEDQSSLSNEDYERYGLNLVPGVKDLLFVPDDSVVPDGLKQGWDVHRNGWPLLKDMIAKNKRLLIFSGNTGRQSIGFMADQRWRVENHWSMGLGLGNSDWACFSRWGNKPLGARPSGKFRPLFFMNHFRDVPMAPTYTTDNEKMRQRAENVCTTAARRKPNFVAVDQYKSGDLFPQIAHMNTYWYQAQAAPGSGGGQQPDPGTPAGDPFDNGVDRRGPKPAEGVPHPSCRPEGMIPTAGASARYCDVYDKEGREWLGGAGHDRRIVGYFNATRNGTDGRPRYLVKNIPWSRVTHINYAFARIEGNRISVGDEGAANNPATRMTWPGVTGAEMDPGLPYQGHFNQLAKYKKRHPQVKALLAVGGWADTKGFYAMATNADGSVNQAGIDAFADSAVDFLGRYGAAFDGIDIDYEYPTAMPDSGNPDDWGVANPRRKGLQAGYNALMKTLREKLDRAGESRGRYYLLTSAASASGHLVRGYDAGQALGYQDYVNVMTYDLHGSWNQYVGPQAPLYDDGRDGELAAAGVYDSVGKPEYGKTGYFNVDWAYHYYRGALQPGRINLGIPYYTRGWRDVQGGTDGLWGTAPLPDQSGCQPGTGTRGFCGNGAVGIDNLWHDTSRGREVAAGSNPLWHVRNLQNGRAGDYLRAYGLDPDAPPNRLTGSYQRKYSNALESMWLWNAEKKVFLTAEDEQSIDAKIRYVKDKGIGGVMMWELAGDLGRGPDGSYGMGHELTNRIDDSLRGAGGYVKERTDGTVPPDQVVDVGVEFADFPTAEADLWPQQPKLRITNRSTRPLPSGTEIAFDIPTSAPALLKDDNWQELKDVLKPGHTGPNAGGLKGTFHRVTLKLGYCESVPAGATRDIGLKYFLPVTGPANITLRFGDGVYGSTQDRRRGATTTQPPAGSGSGPACQAEPWSADRTYNPAWAPFALWRTGDGYKIQDVNSSLVLDHPGSWTTTHLVDSQDGNRNQIWKITPDGSTGRFRITSDSGGRDQCLGAENRLAELSVKNCDGSAAQSWSFTDDKGAPVAGIPADGKAHGLLAARGHAAEPRNSGTTVRTKMVAGDPTGVTRTVVSYGGHWWKAKFWTKGNAPNAADARNPWTRLGPVG

SEQ ID NO: 44308 - protein, 790 aa, Streptomyces tsukubaensis NRRL18488
MRAPHQEDPNVLSPRRTRATLFAAGAAAVGGLLATTLSSGVSQAASQENCRPEGLYSTPGVNVPYCTVYDTEGREKMGADHQRRIIGYFANWRTGQDGRPAYLANNIPWDKITHINYAFAGIDSANKISIGAAGPTNPNTGMTWPGVAGAEMDPALPYKGHFNLLNKFKKLHPDVKTLISVGGWTDSGGFYKTTTNADGTVNTAGINTFADSAVEFIRQYGFNGVDIDYEYPTSMKDAGNPADWTVANARRAGLNKSYSVLMKTLREKLDRASAADGKHYLLTIAAPSSGYLLRGMETYETAKYLDYVNIMSYDLHGTWNEHVGPNAALYDDGKDTELAPVYGTSQYGGIGYLNTDWAYHYFRGSMPAGRINIGVPTYTRGWKNVQGGTDGLWGKSVANSCPPGSGLTKCGDGAVGIDNIWHDKDTNGQEAPAGFNPMWHAKNLEKGIVPDYLPKFGLPANSTLTGTYVRKYDSTLVAPWLWNAQKKVFISTEDEQSMTAKADYVVNKGLGGTMIWELAGDYDYNTAKGQYEPGSSLISLMYNKYKAATPYGVKKSNTALPTEAINLGVEFGGFQLGDNNYPLSPKLKITNNTTATLPGGTEFQFDYATSAPSNAKDQSGFNSRIVSSDHTGNNVGGLKGDFHRIALKLPAWQTVAPGASVELDFVYYLPTSTPSNWTVTFGGKTYAVAGDLARGTTVVDPGSGGTTGTTGTTGTTGTTGTTGTTGTTGTTGANGSTTGGCTAPAWDRNTEYPANSQVSHQGKNWKSKWWTKGDEPGTSQWGPWQDLGAC

SEQ ID NO: 44309 - protein, 192 aa, Streptomyces tsukubaensis NRRL18488
MMRRKALSILLSVSVLGSGLTACQGGSAENADAKPVHPAAIARPAGDARGTALLGDAVDLGGRASGEHLRMSATAYVDPAVPVRKTGVPVSRPAEGMRRVGIRVALLNVGGSSYDASGTQTWVTDTAGKRHPAVSGGEITTGLPVKWNILAAGESVDGWLLFDVPESAALTQFHGDLGKSVVEWRLQAPPSR

SEQ ID NO: 44310 - protein, 148 aa, Streptomyces tsukubaensis NRRL18488
MAEKRAANPGARVVTVNYGTSGAPSFRSQIARSTQVWNSTVTNVRLQEGPSPSFTYREGNDPRGSYASTDGRGRGFIFLDYRQNQQYNSNRVTSHETGHVLGLRDNYRGPCSELMSGGGPGPSCQNDVPNSAERSRVNQIWAGLGRTS

SEQ ID NO: 44311 - protein, 775 aa, Streptomyces tsukubaensis NRRL18488
MPQPLWSRRSFVTAAGTAGALAALAPAAPAPPDPYELLRNRWLEISLGSGYDPAAEPYASRIAETTRLAAVHRAALAPGPGSLWPDLPLLPPAPPAHITRSFARLWVMAQAYTYGTGDGSGLLADTVHGLGHVTALAYHPGNEPRGNWWEWRIGSPRLLMDLVAVLHDHLSADAIATACAAVDHFVPDSLLTDYSGISTGANRVDLCRSTALRGILGRAPQRIALARTALSPVFPYVTEGDGLYADGSYVQHTRVPYTGTYGQVLLDGLARLFALLDGSPWEITDPARRNVLDSVDRAFSPLIHNGLIMDSVNGRAVSRGLGRDDDRRILRGDHYHGHAVIAAIALLARGAPPADRDRWYARIKGWAARDTTGSLLISPRHGTADLARLAAAAAAPVPTAPRATGHTLFAAMDRAVHRRPGWTVNIAMASDRTAYYECGNGEHPRGWHTGAGMVLWWPEHSLGDQYTDWFWPTADPYRMPGTTVSTRRLADFAGGEWGEPRPAARWAGGVTDGTYAAVGQDLRGLGSTLRARKSWFCADDAVVCLGAGISCTDGVPVETVVDHRNLGASGRARYRYGARWAHLEGHGGWVLPGGTRRLHSRHEDRAGAWADINTGGSAERVTRRYRTLWLDHGTDPVDASYLYLLMPAASPARTAARAADPHWLTVLANDARCQAVALASLGLTAANFFATGTVGPLTASAPLSVLIREQGREAALWLADPERSRSPVEIVWRRPVRAVESRDPAIEVLATGAAVRLRLHPGTAGTSRGCRMALG

SEQ ID NO: 44312 - protein, 332 aa, Streptomyces tsukubaensis NRRL18488
MPRSPLPLPRRAAAAAVSAVLAAAALTAAAPPAAAAPESTAPALRVLTYNTFLFSKSLYPNWGQDHRAREIPAAPFFRGQDVVVLQEAFDNSSSELLMRRAEGEYPHRTPVLGRSRSGWDATGGAYSAATPEDGGVTVLSKWPVVRKEQYVYADACGSDWWSNKGFVYAVLDVNGARVHIVGTHAQSTDPGCAAGAAADVRARQFRELDAFLDAKRIPASEQVIVAGDLNVDRHAPEYAAMLAGAGLVDADGRAGHPYSFDTTGNSIAAERYPDEPSEDLDHVLHRAGHARPAGWTNETMAARSAPWTVTSWGRTYTYTHLSDHHPVVASGR

SEQ ID NO: 44313 - protein, 359 aa, Streptomyces tsukubaensis NRRL18488
MRRTFGVRIALSVLLTLPAAGIGAGTAGAAPGPGPAPAPGPGVAASATAYALDAELERTLGDRGAGSYLDTRTGELTVAVTDAAAADEVRASGARARVVERSTAQLEDVMGVLETRAKIPGTSWGIDPSANQVVVEADQSLGVRSLARLRTVAATLGDAVRIERVPGVFTKEVNGGDAIYGGGYRCSAAFNVVRNNVRYFLTAGHCTNVASSWSAVSGGPRIGLREGTSFPTNDYGIVRYDGTDVPPGTVNLYNGGSQDIVSAADAIVGQSIQKSGSTTKVTGGTVTAVNVTVNYSDGPVYNMVRTTACSAGGDSGGAHFSGSTALGIHSGSSGCSGTAGSAIHQPVREALSVYGVTVY

SEQ ID NO: 44314 - protein, 289 aa, Streptomyces tsukubaensis NRRL18488
MTGLLAGTVLFGPEAVARDGSPTVFSTAQLTSAGRALDGSGVTGIAWAVDRKAGVVQVLADDTVRAAQLAQLRSAAGPLADALRVERAPGRLAERGPLGGDGFRSSLGPCTFAFNVRIGSGWYVITAGHCILRVQYIYERRVPWPPPEPPLGQVVRVDYPGNDFGLIRYLQPPQDALGSVNLHNGTVQDITTAGDPALGQPVCFSGSTSGRGCGQVTGLNWTVSLAGGSVHGLIRTNICSAAGDSGGPLFAGTTGLGMASVGSGSCATGGVTFFQPLGEALATYGATVY

SEQ ID NO: 44315 - protein, 303 aa, Streptomyces tsukubaensis NRRL18488
MKVKSLLSPLVKRPVGRRGSAAVIAGLATIAALVAPTAVAAEAPAGKASAAQLATASKAVLTADVAGTAWYTDKASGKIVVTADSTVSQAAIAKIKKTAGSQAGNLVVKRTPGKISRLIAGGEAITSAGVRCSLGFNVIGPGGYHALTAGHCTVGRPSWSIGTTVTSPNQQVFPVYDHGVIRHSNPAAADGRVYLYNGTYRDIINSGYPSVGTRIERSGSTTGYRTGSVTALNVTVNYGGGQLVYNTIQTNACAQPGDSGGPLFTGNTALGLLSGGSGNCSIGGTTFYEPVQRPLSLYGYSVF

SEQ ID NO: 44316 - protein, 417 aa, Streptomyces tsukubaensis NRRL18488
MALPLIAAGTGQAASVDVWEKVAACESANNWRINTNNGYYGGLQFSQSTWEAFGGRDYAPRADLASKEQQIAVAERVLDAQGPGAWPSCSQKAGLTRGGDAPDVSPERRGGDQPGAAAQGGRAAAESVRKAATPQRTAPKQQKATPTTVPTQREGYTVARGDSLSRIADTKNVQGGWPKLYEQNRSTVGSDPDLIMPGQRLVIRMAAPAKQAPAKERAAEPRKAPAKANPPQTRKQAPAKPAAEPRTKDTRAERPAAKPAKSAKAQQPQRSQQQTRKQAAPARAGLSAPVDGSVGTAYRKSGSAWSSGYHTGIDFPVATGTSVKSVANGLVISAGWAGAYGYQVVVRHNDGRYSQYAHLSALTVRSGQQVASGQRIGRSGSTGNSSGPHLHFEVRTGPGYGTDIDPVAYLRSGGVSL

SEQ ID NO: 44317 - protein, 193 aa, Streptomyces tsukubaensis NRRL18488
MPYSIWLKAVSIAAAATLAAAPAANAASEPERAAGANAAAAVTLYYDDSRAGGWEVAIAAGVALWNANVDNVRLVEAAPGAPAEIQIVATSGWPQATLGPVRPGGRSRVELGSQAVAQGYDKIRIAAHEIGHNLGLPDTKPGPCSQLMSGSSPGTACRNAVPNAAEQARVESAYAPRTASRAPADGRIMVDAP

SEQ ID NO: 44318 - protein, 455 aa, Streptomyces tsukubaensis NRRL18488
MVRTQHRTRLVTLMSTLLLAGLLPAAGAGAAGPACAGDRLHVPGAEHVVGHCPDDLTTAGLLPLGLTNPADYDRLHASNTAAPSPVPGIQLDGYFPDTSTTNTNNGWNHDSQFVIRLPKRWNGGLVVAGPPGIRRQYANDRIISDQVLARGFAYAATDKGNTGPQLYRDGAQPGDAIVEWHFRFTQLTLAARRVAARHYGRPATRTYAAGLSAAGYLVRRQLEHFPHLYTGGIDWNGLLLTRDEPGLLAHLPAALRAYPRWERQEPGAADAMYAAGYPKGSEALWKAHYLTQWDLLQRVFREELDPEYDGPAQAGTPFCPEGTGAGCDTDYDYASRPARVHDTVERASLTGRIGRPLITLQGTLDVMLPISHTGDVYSGMVDDAGRGALHRYYRIQDGTHTDGFHDLAPGTVRPMLPCFTAAFDALVAWTTRGVAPPPGRTVPRPADGTATGCGL

SEQ ID NO: 44319 - protein, 243 aa, Streptomyces turgidiscabies Car8
MLFSGKGKHRRPSKATRVVAIAGVTGAAVAAPLLAAGSASAATSAEWDTVAQCESGGNWSINTGNGYYGGLQFSASTWAAYGGTAYAGTADQASKAQQITIAEKVLAGQGKGAWPVCGTGLSSASYDGGSSRGSGSSTGASDNNSSSSSNNSSGSGETSTRSTDNQQASRSQERPAAKKTVTTPTGKKVKKGDGEYKVVKGDSLSAIAEAHHVKGGWQKLFQLNKDIIDDADFIFPGQQLHLS

SEQ ID NO: 44320 - protein, 333 aa, Streptomyces turgidiscabies Car8
MLSGNGRHRRPRQAPALLVSAGVAGSAIAIPLLGATGASAASGTTWDRVAECESGGSWSANSGNGFYGGLQLTQADWEKYGGLSYAPSADQASRSQQIAVGEKILDDQGAGAWEACALLSGLGKDTGSADVDTGVAGGDTDASKGDASGLGLGVISGSGSDSSSSSSTSASPTPSVSPSTGSSALTGGLDSSPSPTPSSGATTGSAGVGDPAGSSASPSPSASSPSADGSKESDSSPVGSVKGQEAGKSGQKAENEGGASSTETPAGTGRHRGKAEGSYTGSIGDALWDVTGSLDLVGGQSESTAGSDAFLDSDSGLVLPGQILAVGSEPGQN

SEQ ID NO: 44321 - protein, 302 aa, Streptomyces turgidiscabies Car8
MRIKRTTPRSGITRRTRLIAVSTGLVAAAAIAIPNATAADVTTFSTAQLTKASGSVLKADVPGTAWAVDAKTNRVVVTADSTVSQAEIAKIKRQAGSTADAITVKRTLGKFSKLISGGDAIYASSWRCSLGFNVRSGSTYYFLTAGHCTDGAGNWWSNSARTTLLGATSGSSFPTNDYGIVKYASSYPVSSISGTVGSVDITSAATPSVNTTVYRRGSTTGIHSGRVTALNATVNYGGGDVVYGMIQTTVCAEPGDSGGPLYSNSGVAYGLTSGGSGNCSSGGTTFFQPVTEALSAYGVSVF

SEQ ID NO: 44322 - protein, 988 aa, Streptomyces turgidiscabies Car8
MAKATFSRRTRATIFTATAGLSLAVALLPGGASAAPGDPAGRPAADSGAPAGSPAGDSPALIPSQQSLARSDARLTKAEQRPGVRQLRKQLGAQGVLELDPDTGTARQVARLDGYLTSASGATPEDIARRYLRAHPDVFGLTAAQVEGLTLRKQYTDVAGIRHLSFVQSVDGVPVFGNGVKANVARDGRLISVLGSPVRGLPSALAPAKITGKQARHNAVRDIAGGTDVSTGSSDTAKQVVYTTPDGAARRAWRTVTAPDGQGMWLHVVDAATGRVLYRQNLSSDLVAEKAGSSEKSASSAKDAGSASLSAGPLLRTGKVLVWDQYPGAKSGGKQHTRHLTARGWLPEGAQTLNGSVAHVFSDVNDNNEVDPGEEVTPGADGTFSFPFKPFTGDGCGTPLPCSWDQKTPNSWQTNREQNAAQVYYFIGTFHDHLEAGPIGFTRAAGNFDSRDGDAVQAQTDDGAAMKDGLPDDDHLNNANMGTPPDGQAPTMQMYLTGSIPGFNVLQGNFGDDAATVYHEYTHGLSHRLITDADGVPALNSEQSNAMGEAWSDWYALDFLNNEGLLKDNRRVDGDVNLDAPGWSDELPARSQSMDCPVGSTSAACHGTAKAGTGGYTYGDYGKISSRGPEVHGDGEIWGETLWDLRNTLGSRLTESLVTRAMELSPVSPSFLDQRNAILQADTVVNGGRAHDRIWKVFANRGMGWFAAALTGDDVLPDEDFSLPPGPNTPVVTLTGKVTDDASGAPVGGVTVSISGHASGFPGADLSAVSAADGTYAIRNVPEGTYRKVYASGNGYEPQIRTLTVAAGAADWSVRRNWSASSGGAEVAEFSGVDYSDFGCGPAGLIDMSANVWGSEANGGTNGTGVDPVHNTVRLPQGVDISELRVDPTSGCGDDVTASLGDYRIETSTDGTTWATAAEGHFGPADTGRENTVALNTGTAQNVRYVRVTMLGNQAVDNGVDCAQDSGSSGCQYMDMTELVVHGAPHQG

SEQ ID NO: 44323 - protein, 326 aa, Streptomyces turgidiscabies Car8
MAVRGKHRRYQPNRINRASLTVTAGGAGIALPLVGAGVADAADMATWNKVAACESTNNWSINTGNGYYGGLQFSQSTWEAYGGTVYAGRADLATRDQQIAVAEKVLKAQGPGAWPTCSVRAGLTRGGDTPDIHPAGGPGDSVGVERKSQRTVRDVKPQTTPQSQAGTAEMYTVVHGDTLSGIADDRSVKGGWQRLYAGNPHVLHVLYNATQAAVTRANPLAASVHPVRVSPSPPATTTDASSSAPPNGTHAYRTPAGPDRTTSRLPGFTTTVYVLPALTPTDWSSTTRLRAVDPTDTGRYDPVQTPSSHFATVIVPCSRPLLSITC

SEQ ID NO: 44324 - protein, 359 aa, Streptomyces turgidiscabies Car8
MKHRRISGRRATMVGASITALVAAGVTFQSANASEVTKTAEPRALSVPAAGKIASTLGKDLGADIAGAYYDAKTKNLVVNVLDETAARTVESAGARARIVENSVAELDSARTTLKQDATIPGTSWAVDPTANKVVVTADRTVSAAEWTKLTKVVDGLGGTAELQRTKGEFRTFVAGGDAITGSGGRCSLGFNVVKGGEPYFLTAGHCTESISTWSDSSGVIGRNESSSFPGNDYGLVKYTADVAHPSQVNLYNGSSQRITGAASATVGQSVTRSGSTTQVHSGTVTGLNATVNYGNGDIVNGLIQTDVCAEPGDSGGSLFSGSSAIGLTSGGSGDCSAGGETFFQPVTEALSATGTQIG

SEQ ID NO: 44325 - protein, 443 aa, Streptomyces turgidiscabies Car8
MSTTVGTTAKRPLRSALVALLAGLLPLLAATFLTAPAAAARTEPAAAPAAAAAALTEVTNFGANPSNLQMYVYVPDSVTTRPAVLVAVHWCTGSGPVFYSNTEYASLADRYGFIVIYPSVTRSSKCFDVSSPQALTRGGGSDPVGIRSMVDWVTRTYNADTSRVFATGVSSGAMMTNVLLGDYPDVFAGGSAFAGVPFGCFATTNGSEWNSECAQGTVTHTPQEWGDLVRNAYPGYTGARPRMQLWHGTEDDTLRYPNFGEEIKQWTNVQGLTQTPSATDSPQSGWTRTRYGATGDKAPVEAISLQGVGHNLITTGMAARVITFFGLDSGGTVPQPPAGACKVAVTTNAWNTGLTASVTITNNTTTAVNGWKLGFTLPSGQSITSGWSATFAPSSGAVTATNVTYNASIAPGASVGFGYQANHTGNSAAPSGFTLNGTACTAG

SEQ ID NO: 44326 - protein, 224 aa, Streptomyces turgidiscabies Car8
MSECADSYTRKTRKTAVLAGAALLAPLGLLAATGNAAAADSGVWDRIAQCESGGNWHINTGNGYYGGLQFSAGTWRAYGGTAYAATADGASKSQQISVATKVQNAQGWGAWPTCSARAGAAGSAPAASGSDSGSSSAATKSTKKSATPSSGRSAASEAPSKAPERSSAHTGRSSSRGDYTVRVGDTLSGIAARYTTTWQHLYAANKAVIGDSPDLIVPGQKLDF

SEQ ID NO: 44327 - protein, 268 aa, Streptomyces turgidiscabies Car8
MTSTTRPRARGRALTGTLATLSLSLGMIMTSGALSPASAATWPTANGSQGVSSTIPVSGTKDYGMKRLYGTGDLGSGGQDENQKPLLELAAGAVLKNVIIGAPASDGIHCKGSCTLQNVWWEDVGEDAATFRGSSSSNVYTVSGGGAKEASDKVFQFNGAGTLNISNFAAKNFGTFVRSCGNCSTQYKRTINLTNIEATWKGGKLAGINTNYGDSATLRGITIVGDSSKKIVPCQKYIGNNTGKEPTTNGSNPDGTYCKYATSDITYR

SEQ ID NO: 44328 - protein, 452 aa, Streptomyces turgidiscabies Car8
MRHARRRIVRRATRLAAVGGVILGGLMVTQAVASEPPEVNLPFSSAQAAGTTGSELVTELGTDRTAGSWIAADGKPVVAVTDAEAATEVEKAGARAKIVDHSMNDLKSATKTLRSAPRVAGTAWAVDYTKNEVVVQADSTVSAADWAKLSAVAKSIGGSVRMERSEGTFTTRINAAQPILSTGGRCSAGFNVTNGSADFILTAGHCGPNGSVWFADTGGSTEIGKTISSSFPINDYSLVQYNGGSAGDGADVVAIGNGRGVRITGAADPTVGQKVFRSGSTTGLRDGKVTGLNATVNYPEGTVSGLIETTVCAEAGDSGGPLFSEGIALGITSGGNGDCKTGGTTFFEPVTEALTALNVRLIGQAGQAAAPAPSGAATQSAVAPGEAQPGSVAPVTGGSAGEALLDKLADPKNVGPGLLIAGGSLIALVATRWFRVEQDRRDYRRSYSATWS

SEQ ID NO: 44329 - protein, 469 aa, Streptomyces turgidiscabies Car8
MGSVAALGAAALLLPNAMASQTDAAAGAAPKTLKATDASDLASQLQQLLGDAFAGSYYDTDKQQLVVNVVEGDNNVIIQAKKAGAAVREVENTIGELKAGAQTLKAKATIPGTAWALDPRTNKIQVTADSTVTGAGWDTIESTVKSLGSGMATIKKTAGTFKPLVEGGDAIFGGGARCSLGFNVVTGDGTPGFLTAGHCGVAAAEWSDAENGEPIATVEAATFPGDGDFALVKYNDPATVAASTVDVGNGQTVDIAQAAEAAVGQQVFRMGSTTGLNDGEVTGLDATVNYAEGTVTGLIQTNVCAEAGDSGGSLFTQDGSAIGLTSGGSGDCTVGGETFFQPVTTALAAVGATIGAGDAGAGAGAGAGEEAGAGEEAGAGQDAGAGEEAGAGQEAGAGEEAGAGQEAGAGEEAGAGQDAGLGEEVGGDELGGVDDQNGNANNNGNANNNGNANNNGADDGTGLGNNENH

SEQ ID NO: 44330 - protein, 271 aa, Streptomyces turgidiscabies Car8
MHTPHIRTSRRTLLTLIGASLVAGPLIVSQSASAVAVGLDDPAKKEIAMKLVSSAENSSLDWKAQYKYIEDIGDGRGYTAGIIGFCSGTGDMLDLVELYTRRKPGNVLAKYLPALRDVDGTDSHQGLDPGYPADWRRAAQDSAFQQAQNDERDRVYFNPSVKQGKADGIGVLGQFAYYDAIVMHGNGGDSTSFGNIRKRALAKAKPPAQGGNEVTYLNAFLDARIWAMKQEEAHSDTSRVDTAQRVFLRKGNLNLDPPLDWKVYGDSFHIG

SEQ ID NO: 44331 - protein, 394 aa, Streptomyces turgidiscabies Car8
MAVRGKHRRYQPNRINRASLTVTAGGAGIALPLVGAGVADAADMATWNKVAACESTNNWSINTGNGYYGGLQFSQSTWEAYGGTVYAGRADLATRDQQIAVAEKVLKAQGPGAWPTCSVRAGLTRGGDTPDIHPAGGPGDSVGVERKSQRTVRDVKPQTTPQSQAGTAEMYTVVHGDTLSGIADDRSVKGGWQRLYAGNRRTIGADPDLIVPGQRLNLRTKAAPHAPVTAEPARKSRTEKAPSRATERPAATQAPKTTTTTTLTSPVSAATGTPYHKAGSSWSKGYHTGVDFPVPTGTSVRAVGVGEVVDAGWGGSFGYQVVIRHSDGRYSQYAHLSAISVRAGQSVSAGQRIGRSGSTGNSTGPHLHFEVRTGPGFGSDIDPVAYLRAGGVRI

SEQ ID NO: 44332 - protein, 280 aa, Streptomyces turgidiscabies Car8
MKRPGVLLLAVAPLLAVTACLSVASDDSRGPDVRRVRSGSLDAEVTLADPAKKELAQQIVASAENGTLDWRSAYGYVEDIGDGQGYTAGIIGFCTGTHDLLTLVEDYTKKHPENALAPYLPALREVDGTDSHEGLDPGFPAAWKQESKVAAFRDAQDEKRDSGYFAPALRLAVRDGLGLLGQFVYYDAMVYHGPGNDPFSVGGIRASALREADSPAEGGDEKTYLSAFLDARRTAMLTKRPGVNTSRVDTAQRRFLDEGNLDLRTPLEWKVYGDAYKVSR

SEQ ID NO: 44333 - protein, 455 aa, Streptomyces turgidiscabies Car8
MSSSPPYETYSPVGGPQPPSPYGGYDPHTAETVAYGVLPYADTYRPAYEPPAPPEPPLPPAGVPRQQAATGPTREGRSREGRAARRRKGSERPDAIRRLLPQALVVAFLAGGTTAFVAKDKAIELSVDGKPRTLHTFADDVTELLADEGVAVGAHDVVAPAPGTALASGDEVRVHYGRPVRITLDGERREVWTTAHTVEEALRQLGVRAEGAYLSLARSQKIGRQGLTIDVRTERTVTIMADGRARTIRTNAATVAEAVREAGITLRGEDALSVAAASFPRDGQAVTVLRVTGSKEVREEEIPYDVRRTQDASLFKGTEIVDQAGSPGLRRVTFALRAVNGVKQKPRRVRTEVVREPRAQLVRVGTKPLPTSVRGADHLDWGSLAACESGGRPNAVDPSGTYGGLYQFDTRTWQSLGGSGRPQDATGEEQTLRAKRLYVKRGAGPWPHCGGRLHG

SEQ ID NO: 44334 - protein, 557 aa, Streptomyces turgidiscabies Car8
MVKAHVSTHELVAGRYRLLDVVHRETNRVSWYGEDTSSERPVVLTQIQLPPDPREQTARRAIARVLRASEILGLVLPGRVGVVIDVLEEFGTLWTVAEWIDGTPLSELLERQGTFNYVRAARITLEVLDVLEAAHREGIVHAELSPGQVFVRDQGPVVVTGFGLAGATSASRVGAPSYASPEQAHGARADPSDDLWALGALLYAMAEGRPPFRDRGRADATLKAVDRLPLRSPVRAGPLTQVIQGLLRKSARERLTAPVARDALLRVIRDEPDTADEPLPSVRVRGAGDAGGARRVGRNGNRSAARKLVLAGAALAAVTVAVLATTDNLPGIDASASGVDTTPSAVAPVPSVPATGGGATLPDQPPAPSPAPSEPTSTTPSAPPSTPPAPSPTPSATGGTAEALPAGFRVYNAPEGFSIALPQGWKRLSEDVSPGNVAYRIVFGADDDPRTLTVTYSQLLRPDPVAVWRDDVQPDLIRADIGFQRIGAIRATTYRGRSGADMEWLSDFEGTRIRTFGRGFLTGEKTGYSLRWTTPAADWNDTANRQALDTFLRTFRE

SEQ ID NO: 44335 - protein, 292 aa, Streptomyces turgidiscabies Car8
MIIRTRCVHESTHRHPGAPDRFRGGSGDDVMNANRIRTFLGAGLTLAVALTLTAGPSPAAAAASWPTAKRTQKVTATIKVPAGTKDYDFTRFVGSGALGGGDQVEGQAPILELADGATVSNVIIGAPAADGIHCRGTCTLKNVWWEDVGEDAATFKGTRANQTMTIDGGGARKAADKVFQHNGPGTFVIKNFQVENFGKLYRSCGVCKTQYQRHVVVDNVSVKAPGLDVVGINATPYGDTAKLTRITVLGDAARKIVICQKFRGTTSGEPAKTGSGPDGRNCVYRASDVTYK

SEQ ID NO: 44336 - protein, 277 aa, Streptomyces turgidiscabies Car8
MEIPVPMMHRAAARRTLLAALGATAILTTQRIASGATTEAAGSGLDDPAKKDIAMRLVCSAENSSLDWRAQYSYIQDIGDGRGYTAGIIGFCSGTSDLLALVELYTERDPDNVLATWLPALRAVDGTDSHDGLDPGFPAAWRKAAKTSAFREAQDDERDRVYFDPAVARAKKDGVGTLGQFAYYDAMVMHGPGADSLSFGGIRDRARTSAASPADGGDETTYLEAFLDARVWAMRQETAHEDTSRVDTAQRVFLGQGNLNLDPPLDWKVYGDSYYIG

SEQ ID NO: 44337 - protein, 221 aa, Streptomyces turgidiscabies Car8
MRKPMSAAVATTLGLSLATLALGTAVPASAAPAPETTSTTVTTAKAAYAGSAEEASANKAFFEAVLKSVAEKRAANPRSAAAVTVIYNASRAPSFSAEIARSTSIWNSSVTNVKLQSGSASAADFTYREGNSSQGSYASTDGHGSGYIFIDYAQSQQYNPTRITAHETGHVLGLPDHYSGPCSELMSGGGPGTSCTNANPNSAERSRVNQLWANGLATAMR

SEQ ID NO: 44338 - protein, 276 aa, Streptomyces venezuelae
  strain ATCC 10712 / CBS 650.69 / DSM 40230 / JCM 4526 / NBRC 13096 / PD 04745
MTSSSPSHRRKTARRRAVIGGLSALGITGAAVVTTTLLAPAGAASALPAWPQANGSKPVPASIEVSGSYDGKLQRFYGTGELGSDGQDEDQPPVFVLKDGAVLKNVIIGSPAADGVHCLGSCTLQNVWWENVGEDAATFKGTSASSVYAVYGGGAKSASDKVFQFNGAGKLVVTKFQVADFGKLVRSCGNCKKQYPRTILVNDVDITTPGKSIVGVNANYGDTASLRNVRVHGDTKKKIKPCTRFTGNNTGKEPTEIGTGPDGTTCRYAATDITYD

SEQ ID NO: 44339 - protein, 143 aa, Streptomyces venezuelae
  strain ATCC 10712 / CBS 650.69 / DSM 40230 / JCM 4526 / NBRC 13096 / PD 04745
MLRRFAAVSASALLCLAGTAGLAEARTDSLYAPSAVVLSVSKGADASSAVVLRAVTLSCAPTAGGTHPAPEAACAELKATSEAGAFDELLAAPDPDRMCPQHYDPVTITVDGVWEGARTSWEYTFANSCTMGVTLNEGAAFSF

SEQ ID NO: 44340 - protein, 536 aa, Streptomyces venezuelae
  strain ATCC 10712 / CBS 650.69 / DSM 40230 / JCM 4526 / NBRC 13096 / PD 04745
MTRTDQVASILPQGTARRSTEPISGPDVYAGGVRGLPGQALVGQSPSAGGRRPYEPRKPVSDTPFGFGLPPEEPENGDEGKKKDPAGGGQGSGGQGGGNPFGANPFGFGGLPGMGGPGGADNPFAAMFGSLNPNDLGAAFQQLGQMLSYEGGPVNWDMAKQIARQVVAQGTADGTKDASVGPAEKAAVEEAVRLADLWLDGVTSLPSGASTAVAWSRAEWVEATLPAWQQLVDPVAERVGTAMGDVLPEEMQAMAGPLIGMMRSMGGAMFGQQIGQAVGALAGEVVGSTDVGLPLGPAGRAALLPLNVEAFGKDLGVPSDEVRLYLALREAAHQRLFAHVPWLRAHLFGAVEGYARGIKVDTSKLEEAVGQLDPTHPEQLQEALQQGMFQPEDTPEQKAALARLETALALVEGWVDAVVHEAAKSRLTSADALRETLRRRRASGGPAEQTFATLIGLELRPRRLRDAARLWASLTDARGVDGRDGLWEHPDMLPTATDLDDPDGFVHREHLDFSEIDKMLGEAAKGDAPEDGDGKA

SEQ ID NO: 44341 - protein, 214 aa, Streptomyces venezuelae
  strain ATCC 10712 / CBS 650.69 / DSM 40230 / JCM 4526 / NBRC 13096 / PD 04745
MRHPKVLTSALTATLGLGLALSLGTAPATAVATAPAGNAAVAYAGSAEEAKANQAFFDAVVKSVAKKRAATPGAAAVTVVYSAANAPSFRTQIARSAQIWNSSVVNVRLVEGSNPDFAYYEGNDSRGSYASTDGHGSGYIFLDYRQNQQYNSTRVTAHETGHVLGLPDHYSGPCSELMSGGGPGTSCQNAQPNAQERSRVDQLWRYGLASAFKS

SEQ ID NO: 44342 - protein, 621 aa, Streptomyces venezuelae
  strain ATCC 10712 / CBS 650.69 / DSM 40230 / JCM 4526 / NBRC 13096 / PD 04745
MCFVLRGSDEAFHRRIGLVLNLVQTIDVLFTRRLSLLQLLYGTTPHSPRWRPHVHPRKPLIAALLSTALAAGALAATVGLGSAQAADTTTTAAAGNVRIAYYDQWSIYGNAFYPKHLDTRGIAGQLDVINYSFGNIHPTNLTCFEANKAAGDDNNPNAGDGAGDSYADYQKSFSAADSVDGVADTWNQPIVGVFNQFKELKAKYPHLKINISLGGWTYSKYFSDAAKTDASRKKLVASCIDQYIKGNLPVEGGFGGPGTAAGIFDGIDIDWEYPGSSEGHLGNHYAPEDKQNFTLLLAEFRKQLDAYGAANGGKKYLLTAALPAGQDKIKYIETDKIGAYLDYANIMTYDMHGAWDGDGPTYHQSPLYSGANDPTDVIAPGTEKYSIDNAIDSWIDGKPAYGITGGFPANKLTLGYEFYYRGWKGVPAGSAGGLAGTATGGSNARPLSQQAGIAHYKELGGIVDNASTTFWDDQAKASYFYKDGEFFTGLNQRSIQARVDYAKQRGLAGAMMYSLLGLDENATLLKQINTALGSTTTPPTTPPTTPPTTPPTTPPTTPPTTPPTTPPTGCGSVPAYVAGTVYTGGTVVFHNGRKWLAQWWTQNETPGTTGEWGVWKDQGAC

SEQ ID NO: 44343 - protein, 500 aa, Streptomyces venezuelae
  strain ATCC 10712 / CBS 650.69 / DSM 40230 / JCM 4526 / NBRC 13096 / PD 04745
MRPAEGGGGGGTDFSGMSHQQMLAWLDEASSFYVGDAARKLKSVAAQLEKIAGELKASMEGMDWEGEAEKAFAEWTINVANTTSKLALYSKRGAIPMDDNSAAIAAAQSAMPRYTSHASAKENLAAARKYHNDPDSQYIAGQARSQMADSEDPAVIKAKEEANRQAAADEMRRLSSTYQWSSYRMSNEVPPVFPPPPGAFVPDAVDDRGGSNRNITSLPQGERHSTSNDTETTTTHTTRPQQDTRTTPDDNVVRPTDDPTRPTHVVRPEVRPDTPVDLGIDSVDTHTLPPTQTTGPTTPTPGGPPPVNKPDFGTPPFVTTGVPPFTGKNGPGPVGPTGPVTGGTRNPLSNGGPRGLPGMPGATREGISGGRQVPHTGRPSTGIPRSTVVGAEQGRNGTGMGRGPMGGGGMGSPMGGGQSGISGGRRLAGETGGVVGGKAQRAGTTGTGGRPFTPGGSGLVRGNTARADEREEQNGERPDYLVEDEETWQQGRRVAPPVID

SEQ ID NO: 44344 - protein, 804 aa, Streptomyces venezuelae
  strain ATCC 10712 / CBS 650.69 / DSM 40230 / JCM 4526 / NBRC 13096 / PD 04745
MLIDCVGNPVLHQAPNGLHHFPREAPVPVPAWSRRTFLTAASAAAVALGLPSAAHAAEDEFEALRLRWLDLQLGSGFDAAAEPYASRLAETGTLARTFRTGMAPTPTSLWPDAPFDPPAGITQSYSRLWTMTQAYIQPGTGLTGDASLLADVLRGLDHLSATVYRAGAPRYGNWWEWQIGSPRLLMDIVAALHPHLGAERIAAACAAVDHFVPDSVLTNYTGTSTGANRVDLCRSVALRGVLGASPAKIALARDALSPVFPYVTRGDGLYADGSFVQHTWIAYSGTYGQVMLDGLGRLFSLLAGSSWAVTDPNRQIVLDSVEKAYAPLIYDGLMMDSVNGRAISRGYLKNDDRRIMRSDHFHGQGVIAAIALLAGGASAAERDRWHARVKGWIQRDTVSPILSARQFGVADLARLHAVAAAPVPAAPEPTGHRLFTAMDRAVHRRPGWAANIAMASDRISYYECGNGENPRGWHTGAGMLSWWTPGLGDQYTDWFWPTVDPYRLPGTTVSTRRLADRAGGEWGAPKPAVRWVGGATDGEYAAIGQHLKGLGSTLEARKSWFCAADAVICLGAGITATDGVPVETIVDNRLLGESGTQAFTTGTGWAHLEGHGGWVFPRGAAPGGADGLRTLREDRTGAWSDINTTSSTERRTRRYQTLWLDHGTDPVAAGYAYLLMPGASRRTLAARAADPGWLHVLDNTAERQAIAVPSLGLTAANLWQAGTVGRLTATAPASVLVRRRRSVLDLRVSEPLRTGQPLELVWDGPVRRVLAHDPSVEVLATGRSLRVRITPGTQGATHRCEVLV

SEQ ID NO: 44345 - protein, 196 aa, Streptomyces venezuelae
  strain ATCC 10712 / CBS 650.69 / DSM 40230 / JCM 4526 / NBRC 13096 / PD 04745
MSLSSWLRTATAGVTVVLATATATTATATPAPTTEPSAVRAAAVVTLRYDDSRAAGWEAAIAAGVASWNAHVDNVRLVEAAPGTRAEIVIVATTGWPQATLGPVRPGRQVRVELGSQAVAQGYDKTRIAAHEIGHSLGLPDTKPGPCSQLMSGSSAGTACVNAVADAAEQARVEAAYANGAAARFVTDGRTLVDAP

SEQ ID NO: 44346 - protein, 428 aa, Streptomyces venezuelae
  strain ATCC 10712 / CBS 650.69 / DSM 40230 / JCM 4526 / NBRC 13096 / PD 04745
MLVPSIDVVVAREILDSRGNPTVEVEVGLDDGSTGRAAVPSGASTGAFEAIELRDGDPNRYLGKGVEKAVLAVIEQIGPELVGYDATEQRLIDQAMFDLDATENKGSLGANAILGVSLAVAHAASEASDLPLFRYLGGPNAHLLPVPMMNILNGGSHADSNVDIQEFMIAPIGAESFSEALRWGAEIYHTLKAVLKRKGLSTGLGDEGGFAPNLESNRAALDLIVEAIKEAGYTPGSDVALALDVAASEFYKDGKYEFEGKSRSAAEMTEYYEELVSAYPMVSIEDPLYEDDWAGWKVLTDKLGTKVQIVGDDLFVTNPERLARGIEEGTANALLVKVNQIGSLTETLDAVELAQRNGFKCMMSHRSGETEDVTIADLAVAVNCGQIKTGAPARSDRVAKYNQLLRIEEILDDAAVYAGRSAFPRFKG

SEQ ID NO: 44347 - protein, 240 aa, Streptomyces venezuelae
  strain ATCC 10712 / CBS 650.69 / DSM 40230 / JCM 4526 / NBRC 13096 / PD 04745
MLFSGKGKHRRPSKATQVVTLVGVTGVAVAAPLMTAGTASAATASEWDRVAQCESGGNWSINTGNGYYGGLQFSASTWAAYGGTAYASTANQASKSQQIAIAEKVLAGQGKGAWPSCGVGLSGASYDGGAAESAPRQSAPQQQERKAEQPTTRSEQRKAPKKAVQQQVAPKAATKKTVTTPTGKTVKKGDGEYKVVAGDTLSKIAQAHGVKGGWAKLFELNKDVVENADLIYPGQQLHLK

SEQ ID NO: 44348 - protein, 371 aa, Streptomyces venezuelae
  strain ATCC 10712 / CBS 650.69 / DSM 40230 / JCM 4526 / NBRC 13096 / PD 04745
MRSGNGRHRRPRQAPALVVAAGVTGSAMALPLLATGSASAADAATWDRVAECESGGQWSANFGNGMYGGLQFTQDSWERHGGLAYAPSPDLASRAQQIAVAEKALAKGSNDWATCAPIAGLTNDGTAPGVDPGPANLPKAPTGPVPESNWTTGLPGASGTAADATKQAGEATTAPGAGKTQGAQRTAPPGSPTAPTGTVSPTAPVTPTTPVSPVSPTAPATPEGSGTPGTPVTPGTPTTPGAPSGDVSSATPGAGTGKHRGEAAPEESGKPDSSSESGRHASSANNLTEKPLNTPSADAAKKSGATDSQGNSDAYTVQPGDSLSDIAQENELPGGWTALYDANRQIVGVDPDLILPGQSLDLTNGSLTKAE

SEQ ID NO: 44349 - protein, 424 aa, Streptomyces venezuelae
  strain ATCC 10712 / CBS 650.69 / DSM 40230 / JCM 4526 / NBRC 13096 / PD 04745
MSTSQGSHRAGRRAAALPVHDQPTQEAPLVAPGLVPEQGTRAGSRAGARRAARRRKASGPAGEGLRRLVPQALVVAFLAGGTSAFVADDKAVRLSVDGVPRTLHTFADDVDELLADEGLAVGSHDIVAPAPAEALASGDEIVVRYGRPVALTLDGQRRQVWTTARTVEGALRQLGVRAEGAYLSVSRGAAISRQGLALDVRTERTVTFLADGRERTVRTNAATVREALTEAGITLSGQDATSVAPDSFPRDGQTVNVLRITGSRQVREEAIPYTVEKVRDPELFAGSEVVERQGVTGVRRVTYSLRTVNGVRQKPRRTAEEIVREPVSRRVRVGTRPLPTSVAGADGLDWGALAACESGGRPNAVDPSGTYGGLYQFDPGTWRSLGGSGTAQNAPAAEQTFRAKKLYVQRGASPWPHCGRRLFR

SEQ ID NO: 44350 - protein, 304 aa, Streptomyces venezuelae
  strain ATCC 10712 / CBS 650.69 / DSM 40230 / JCM 4526 / NBRC 13096 / PD 04745
MLRKLVTSLAALCTVVGLAVLFLPTASAGAAAACAAAWNSSSVYTGGMTASHNGHNWQAKWWTQNETPGTTGEWGVWADQGVCGGGGGTTPPTTPPPTGGFVVSEAQFNQMFPSRNPFYTYAGLVAALKSYPGFATTGSDTVKKQEAAAFLANVSHETGGLVHIVEQNTANYPHYCDASKPYGCPAGQAAYYGRGPIQLSWNFNYKAAGDALGIDLLNNPWRVEQDPAVAMQTGLWYWNTQNGPGTMTAHNAMVNGAGFGQTIWAINGSLECNGGNPAQVQSRVTKYQQFTQILGVPAGSNLSC

SEQ ID NO: 44351 - protein, 433 aa, Streptomyces venezuelae
  strain ATCC 10712 / CBS 650.69 / DSM 40230 / JCM 4526 / NBRC 13096 / PD 04745
MVSPAVEFTVIHSVTARRVIDSRGNPTVEADVLLADGSLGRAAVPSGASTGAREAVELRDGDAGRWHGKGVDRAVAHVNGEIAATVVGRDARDQAGLDAALVALDGTADKSRLGANAILGVSLAAAKAAAAAHRQPLYRYLGGADARLLPLPMMNIVNGGAHADNPLDFQEFMIAPIGAGTFAEAVRMGSEIFHTLRRDLLSAGHATGVGDEGGFAPSLRTAEEALDFVMAAVERTGYRPGTDIGLVMDPASSEFFRDGTYVYAGEGVRRTPTEHADYLAELIEAYPIVSIEDPMAEDDLDGWRELTARVGDRCQLTGDDVFCTNETLLREGIRTGVGNSVLVKVNQIGTLTEALSTVDTAHRAGWTVVMSHRSGETEDTTIADLAVATGCGQIKTGSLSRSDRTAKYNQLIRIEEELGASARYAGESALTRP

SEQ ID NO: 44352 - protein, 793 aa, Streptomyces venezuelae
  strain ATCC 10712 / CBS 650.69 / DSM 40230 / JCM 4526 / NBRC 13096 / PD 04745
MLSPTTKRASLLASGAAVAGLLLSSLSGGVSYAADNESCRPDGLYKTPGVDVPYCSVYDTEGREKMGADHQRRVIGYFTGWRDGKNGQPAYLAKDIPWDKITHINYAFGHIGGDNKLSVGTDGPNNAATGMTWPGVAGAEMDPAYAYKGHFNLLNKFKKQHPNVKTLISVGGWAETGGYFADNGDRVNSGGFYSMATNADGSVNQAGIDTFAASAVDFIRKYGFNGVDIDYEYPTTMKDAGNPLDWQLANARRAGLVQGYAALMKSLREKLDTAGATDGKHYLLTVAAPSSGYLLRGMETFQMQKYLDYVNIMSYDLHGAWNEYVGPNASLFDDGKDGELAAANVYGSAQYGNIGYLNTDWAYHYFRGSMPAGRINIGLPYYTRGHKNVQGGTDGLWGKATATTCPAGAGLTKCGDGATGIDNLWHDKDTNGVESPAGSNPMWHAKNLEKGIVGDYVTQYGFPANTTLTGTYARKYDSTLVAPWLWNAQKKVFLSTEDEQSVAAKADYVVNKGIGGTMVWEMAGDYAWNATKGQYEMGSTLTSLMYDKFKAATPYGAKKSNKALPTQAVKIDAQFTEFKLGDSNYPITPKIKITNNTATALPGGTEFQFDYGTSAPANASDQSGFGTKVISSDHTGSNVGGLKGDFHRVSLKLPAWQSLAPGATVDLAFNYYLPVSTPSNWTVNINGTTYALAGDLARGTTVVEPGTTTPPTTPPTTPPTTPPTTPPTTPPTTPPTTPPTGCGTVPAYVAGTVYNSGNEVSHNGRKYRAQWWTQNETPGTTGEWGVWKDLGPC

SEQ ID NO: 44353 - protein, 346 aa, Streptomyces venezuelae
  strain ATCC 10712 / CBS 650.69 / DSM 40230 / JCM 4526 / NBRC 13096 / PD 04745
MCGASSTPHILMGVPLSLVASLRRAPGAALALALAAATLAVTAQGATAAPAAAAAEAPRLKVLTYNTFLFSKTLYPNWGQDHRAKAIPTAPFYQGQDVVVLQEAFDNSASDALKANSAGQYPYQTPVVGRGTGGWDATGGSYSSTTPEDGGVTILSKWPIVRKEQYVYKDACGADWWSNKGFAYVVLNVNGSKVHVLGTHAQSTDPGCSAGEAVQMRSRQFKAIDAFLDAKNIPAGEQVIVAGDMNVDSRTPEYGTMLADAGLAAADARTGHPYSFDTELNSIASERYPDDPREDLDYVLYRAGNARPANWTNNVVLEKSAPWTVSSWGKSYTYTNLSDHYPVTGF

SEQ ID NO: 44354 - protein, 299 aa, Streptomyces venezuelae
  strain ATCC 10712 / CBS 650.69 / DSM 40230 / JCM 4526 / NBRC 13096 / PD 04745
MRTTPTRTVRLLAVAAGLAAAAALAAPTASAGTADSARSTRTFDAAALSATGDAVRAADVAGTAWYADTATGELVVTADSTVTPAGIAKIKRQAGANADAIRVERTPGKFTKLISGGDAIYATSWRCSLGFNVRDSAGNYYFLTAGHCTDGAGTWYSNSSRTTVLGTTAGSSFPGNDYGLVRYTNSSVTKSGTVGSVDITSAANATVGMSVTRRGSTTGIHSGSVTGLNATVNYGGGDIVSGLIRTNVCAEPGDSGGPLYSGSRAVGLTSGGSGNCSTGGTTFFQPVTEALSAYGVSVF

SEQ ID NO: 44355 - protein, 199 aa, Streptomyces venezuelae
  strain ATCC 10712 / CBS 650.69 / DSM 40230 / JCM 4526 / NBRC 13096 / PD 04745
MSKIRFWTTGSLVVSAAALLALAPAPAQARDVADGPRTTSAAPRTVSAGLRAATAVPPYACAVDQWPWGCVAECESSGDWHTNTGNGFYGGLQFWHPTWVEHGGLRFAPRADLATRPQQITVAEEVLRTQGWAAWPVCSKRYGLSGRVHTVQPGDTLSSIARRFGIEGGWEALYAANRDVVGPDPNRVVVGTMLRIDPL

SEQ ID NO: 44356 - protein, 274 aa, Streptomyces venezuelae
  strain ATCC 10712 / CBS 650.69 / DSM 40230 / JCM 4526 / NBRC 13096 / PD 04745
MDHETSTGHVTRKAVLRAAFAAGIAAPAVLMGVPALARTLTEGEAAPALTPECDDGDDPTPPQTEGPYFKPSSPLRSSLVEPGTAGARLTVSGYVFGLACRPLAGVLLDFWQADTNGAYDNTGYRFRGHQFTDAQGAFRLATIVPGLYPGRTRHLHVKVQAPGRPVLTTQLYFPGEPRNNTDSIFDARLLMSVRDAGPAKEAAFDFVLNVPQGPGPSPTATATTPPPGGSWAAGTAYRAGDRVTYGGLAYVCLQAHTGQAGWEPPNVPALWRAG

SEQ ID NO: 44357 - protein, 471 aa, Streptomyces venezuelae
  strain ATCC 10712 / CBS 650.69 / DSM 40230 / JCM 4526 / NBRC 13096 / PD 04745
MAVRGRHRRHQPSRINRASLTVTAGSAGMALPLIGAGAVQAASLDVWEKVAACESTSNWRINTGNGYFGGLQFSQSTWEAYGGTHYAPRADLASKDQQIAIAERVLKGQGPGAWPSCGARAGLERGGDAPDVTPGGTAKARAKSPGGNAVSTASLPGQRALPERPTRNVGPTAVPTVREMYTVTPGDSLSKIARDERVRGGWKGLYDTNRAVVGDDPDLIHPGQRLTLRMVAPRKPATPEAHVPTAPPAKAPSATKPPAKTSAQVPRTRPAAHPATKPAAKPVGQSARPAAPSGTKPAAKPSTRPAPKPVTRPAAKPAAKPAAKPRPASKPRPAPAQARYSAPVSADIGTRYGTRGSSWSSGYHTGVDFPVPTGTSVKAVAGGRVVSAGWGGAYGYQIVLRHDDGRYSQYGHLSALAVREGQRVTAGQRIGRSGSTGNSSGPHLHFEVRTGPGYGSDIDPLAYLRARGVSL

SEQ ID NO: 44358 - protein, 325 aa, Streptomyces venezuelae
  strain ATCC 10712 / CBS 650.69 / DSM 40230 / JCM 4526 / NBRC 13096 / PD 04745
MDTEPGAGRRDRDVDWLAAHPDLPHLFAHLSELVHASGYPPGELVVIPRAEIDRRETAAFTAGWAEAVSDELPRIRQEYEKRVADAYAQGQGDARGVRRPQRRTDTGQEGARVIALPFAWLLEPPAAVVEAEERVRREREMFEQRADPGPRSDSGSRADPGPRTDSGSRADPGPRTDPGPRTDPGPRTDSGPRADPGPRSDSGPRSDPGSRTPAGPREPEPEHRKEAEPDPEPDVLLTAQESRARRNAQPVRKVVRGKGGRPIVPPLAGVPAQVGPAADRRDADAAAEPEPRAGRGQRLSDRARALEKDMTAERAREEAPPEPMP

SEQ ID NO: 44359 - protein, 192 aa, Streptomyces venezuelae
  strain ATCC 10712 / CBS 650.69 / DSM 40230 / JCM 4526 / NBRC 13096 / PD 04745
MAASFRTVVEVAPDHLAQARSIDRVFQDAIAPATVNFDFEAIREAAAAVPDSTVVKMVRGWGLQEYAPVLVMVLSLKEAVRQALPPECAEAGFWATVERELVRAFTGLAAQEGQPGLSFYEESGERTRFYRDLFFALQDEGTGEHMYALAFCVDVTVELPKAEAVALELTDVVPFAVRLNAIVVRQALDLVA

SEQ ID NO: 44360 - protein, 456 aa, Streptomyces venezuelae
  strain ATCC 10712 / CBS 650.69 / DSM 40230 / JCM 4526 / NBRC 13096 / PD 04745
MLRRHARAACTALVAAGLALAGLQAGTAAAVPDAGEPHPAPTVRTAAQTLGADAAAPEVLDAMRRDLGLSHAQALTRLANEAEAGATAARLRQGLGGAFAGAWVDGAESGTLTVATTRSSDAAAIRATGARARLVTHPLTILERAKERLDRAATADAPVRYVDVRANVLVVEETKAGAGARLLAATGVPRELVRVVRSGQAPRPLYDLRGGDAYYMGGGGRCSVGFPVTRGTTQGFATAGHCGRAGTTTSGFNQVAQGSFQGSIFPGNDMAWVAANGNWTATPYVKGSGGANVQVTGSVLQPVGSSVCRSGSTTGWHCGTVQQHNTSVTYPEGTISGVTRTTVCAEPGDSGGSYISGSQAQGVTSGGSGNCSSGGTTFFQPLNPLLQNYGLTLKTTGGDPGPGPGEPEPGGSWAAGTVYKAGDVVTYGGASYRCLQGHQAQAGWQPPNVPALWQRL

SEQ ID NO: 44361 - protein, 204 aa, Streptomyces venezuelae
  strain ATCC 10712 / CBS 650.69 / DSM 40230 / JCM 4526 / NBRC 13096 / PD 04745
MRPLITQSPGGTMRRTAIAATTAALALTLAACTGTEPEVATKPDPKPTSPAASEAPAKTTEAPAPKDAGLGDTITLKGLEDGEQISVTLKKVSDPAVPKDEFFNPDEGNRWIGIQIEIVNSGTAVYDDSPSNGMQVADADGQRFNGVIAEIKAGPAMAAGVTLKPGAKALGWLVFEAPKNSKITTVQFGMNSGFSDQTGEWTLK

SEQ ID NO: 44362 - protein, 380 aa, Streptomyces venezuelae
  strain ATCC 10712 / CBS 650.69 / DSM 40230 / JCM 4526 / NBRC 13096 / PD 04745
MKRTSALRAAAAALLLTVGLGAAQAVPASAVPTATPPAASAGLLDAMRQDLGLDARQAEERLAAERAAARVESEARKTAGGAYGGAWFDSGTGRLVVALTDRDEEAGVRALGADTRLVRHSAAALDRAKARLDAAPAPAGVAGWHVDPRSNSVVVTVVRAERNRPAVRAFVDRARAAGPVTVAETATAPRTYAAGTVGGDPYYTGNVRCSIGFSVHGGFVTAGHCGGAGAAVRGWDGSAMGTFQGSSFPGNDYAYVSIHSGWWTVPVVLGWGVIPDRLVRGSAEAPVGASICRSGSTTKWHCGTVLAKNETVNYSQGAVHQMTKTSVCAEGGDSGGAFISGDQAQGVTSGGWGNCSSGGETWFQPVNEILTRYGLTLHTA

SEQ ID NO: 44363 - protein, 834 aa, Streptomyces venezuelae
  strain ATCC 10712 / CBS 650.69 / DSM 40230 / JCM 4526 / NBRC 13096 / PD 04745
MSAQGLSVQFHITMLHRTRCDEPSSNPVCTTTVLVPHPRRPPHTHGVLLSIHRRVRSSLLTSAVAVTLLATSAQTGAFAADTDARATAVPAATTGAPAPRAEHATNPFDEVERLATAPRQTFGPAPAPGNLAAGRVPGRAPAPASTARTLAAATTTTAAGVPCTLDGITGLGPEQFADFLADPAVLADGCLRGLIWTWDARLAPVMSDAHVQAVSRRISSLAAAHDGRNSSHLEEMFTYLHAVAYHDHSRGEIDVTDAPTVNAMRQAVADFGNAARTFDVTKNNALTLREALYAASAPGLRQHQLGLIKRVLATMDPAHTATHLDVSWAGAALAALSVNYLGVYPGNQDTAFQAAAAADPAYRAVFKAFAGYGHLKGTANDWVARDALSEFGRFGEIAALRTETTAELGGLLGQAVTTFGRGSQQWAKIVSWLNYFDACKPYGVCKADIEAQIFPYTYTYDNGAIKVRTGLDRATVDQLYYASKQVKAQFHRVVGSDRPLAGDPNTTLTIVLYGSRADYENYHPILTGMDTNNGGIYIERGATFYTYQRRVPQDSSLTLEELFRHEYTHYLNGRYAVPGFFGEGPWYQGDRTTFMDEGTAEFFDGATRDDGIKVRKSLVRGVINDTAGGGPRMNLRQILNATYDGDGFRFYNYAGTFFEFLWNEKPSLIREMYTHLRNNDVAGYDAWRVRLGNDTGLQADYNRFLDTQIAKVDTLYVPNTTYTPNGQLRDSTVSAVRSAFATATYNTPDCVENGEPGKRRFLCTGRITANLSNWASPDQNFKDMSETVDYFILDRAGAASNNLADMNCSFGPVEIWTNKVAGTSSFSCEGPLRS

SEQ ID NO: 44364 - protein, 280 aa, Streptomyces violaceoruber
MRHPFRDPARPAGPSRRTVLAMACASLATVPLFTPSRAAAASARATGLDDPAKKEIAMQLVSSAENSSLDWKAQYRYIEDIGDGRGYTAGIIGFCSGTGDMLDLVELYGQRSPGNVLASYLPALRRVDGSDSHEGLDPGFPDDWRRAADQDPQFRRAQDDERDRVYFDPAVRRGKEDGLRTLGQFAYYDAMVMHGDGGGLGFGSIRERALGRARPPAQGGDEVAYLHAFLDERVWAMKQEEAHSDTSRVDTAQRVFLNEGNLDLEPPLDWHVYGDAYHIG

SEQ ID NO: 44365 - protein, 280 aa, Streptomyces violaceoruber
MRHPFHDPARPAGPSRRTVLAMACASLATVPLSTPSRAAAASARATGLDDPAKKEIAMQLVSSAENSSLDWKAQYRYIEDIGDGRGYTAGIIGFCSGTGDMLDLVELYGERSPGNVLAPYLPALRRVDGSDSHEGLDPGFPDDWRRAADQDPEFRRAQDDERDRVYFDPAVRRGKEDGLRTLGQFAYYDAMVMHGDGGGLGFGSIRERALGRARPPAQGGDEVAYLHAFLDERVWAMKQEEAHSDTSRVDTAQRVFLNEGNLDLEPPLDWHVYGDAYHIG

SEQ ID NO: 44366 - protein, 280 aa, Streptomyces violaceoruber
MRHPFRDPARPADPSRRTVLAMACASLATVPLFTPSHAAAASARATGLDDPAKKEIAMQLVSSAENSSLDWKAQYRYIEDIGDGRGYTAGIIGFCSGTGDMLDLVELYGQRSPGNVLAPYLPALRRVDGSDSHEGLDPGFPDDWRRAADQDPQFRRAQDDERDRVYFDPAVRRGKEDGLRTLGQFAYYDAMVMHGDGGGLGFGSIRERALGRARPPAQGGDEVAYLHAFLDERVWAMKQEQAHSDTSRVDTAQRVFLNEGNLDLEPPLDWHVYGDAYHIG

SEQ ID NO: 44367 - protein, 146 aa, Streptomyces violaceus
  Streptomyces venezuelae
MRRTLKAVGAAAAAATCVLAATAGTAQAEAPKAESLYAPSALVLTVGQGENAESAAVERAVTLTCAPRPGGTHPSAAAACAELAKVNGQFARLVGASSDAICTKEWRPVTVSVVGAWNGKHVNWTSTFANQCTMKAGLGEGAALTF

SEQ ID NO: 44368 - protein, 15 aa, Streptomyces violaceus
  Streptomyces venezuelae
EQPGGDKVNLGYFTN

SEQ ID NO: 44369 - protein, 183 aa, Streptomyces violaceus
  Streptomyces venezuelae
MRKIVVAAIAVSLTTVSITASASADPSKDSKAQVSAAEAGITGTWYNQLGSTFIVTAGADGALTGTYESAVGNAESRYVLTGRYDSAPATDGSGTALGWTVAWKNNYRNAHSATTWSGQYVGGTEARINTQWLLTSGTTEANAWKSTLVGHDTFTKVKPSAASIDAAKKAGVNNGNPLDAVQQ

SEQ ID NO: 44370 - protein, 183 aa, Streptomyces violaceus
  Streptomyces venezuelae
MRKIVVAAIAVSLTTVGITASASADPSKDSKAQAAVAEAGITGTWYNQLGSTFIVTANADGSLTGTYESAVGNAESRYVLTGRYDSAPATDGSGTALGWTVAWKNNYRNAHSATTWSGQYVAGSEARINTQWLLTSGTTAANAWKSTLVGHDTFTKVKPSAASIDAAKKAGVNNGNPLDAVQQ

SEQ ID NO: 44371 - protein, 264 aa, Streptomyces violaceusniger Tu 4113
MAEQRTRHRAIAGVLGAVALTAGAITTGLTLPAASAATWPTPSGTPQAVSKTIGVSGTTDGGMKRYYGSGDLGGDGQEEDQGPLFELKDGATLKNVILGAPAADGVHCEGSCTLQNVWWEDVGEDAATFRGTGKTFNVIGGGARKAADKIFQFNGGGTLNISNFAGQDFSTFVRSCGNCSSQYKRTINVSNSEITAPGKVIGGINTNYGDSLTLRGITIVGDSSKKIVPCQKYIGNNTGAEPSKNGSGPDGTYCKYSSSDITYR

SEQ ID NO: 44372 - protein, 397 aa, Streptomyces violaceusniger Tu 4113
MRRKPVVRAGLSALLVLGALSGAGGAFSTAAAASGADAPAAKPAGASAPSAGLVRALGRDLGLTADQARERLGQEAAAMKLESKAERAAGASYGGSWFDTSSGKLVVGVTGAERAASVRATGATTRIVQHSAAALDAATARLDDKARKKAAPAGVSSWSADPRAGGVVVRVREGSEGDAAVRAFLREAKRSSSVPVTVEKAPAQAPTTFAAGTVGGDPYYTGNVRCSIGFSVQGGFVTAGHCGQAGGSVSGWDGSYIGNFQGSSFPGNDYAYVSVGSGWWTVPVVLGWGTVPDQLVRGSNEAPIGASICRSGSTTHWHCGTVLAKNETVNYSQGAVYEMTKTSVCAEGGDSGGSFISGDQAQGVTSGGWGNCSGGGETWYQPINEILSVYGLRLHTA

SEQ ID NO: 44373 - protein, 185 aa, Streptomyces violaceusniger Tu 4113
MRSSKFVRALPAAVTAVLALTAGQAVAAPASAAPAEHTAAARIVTYDAGGAAEFKDAVSKGAAIWNESVANVELKPAASGQQANVRIIADNGWPRTLSTGLGRGTIYFGRQAVDEGYNTVRISSHELGHILGLPDMKPGPCSSLMSGSTAGIPCTNPYPNTAEKAEVEDSFGLVGVTAAPRMYRD

SEQ ID NO: 44374 - protein, 374 aa, Streptomyces violaceusniger Tu 4113
MRRRHHAYRGIVAAVVGGLLTLTTLTAAQAAPAPLTDPAKAAAIVDQLGNKRTAGIYYRNERLVVAVTDQAAAETVQSAGAVAEVVLHSTTELSSAKAKLDQLEGVPNTAWSIDQTSNRVNVQIYDGVSDADRSRIEKAVSGYGDAVDITEHSSKIESTAYAMRGGLGITSECTSGGSGWITTCTAGFNVQNASGKKYMLTAGHCMEDGAVTWHRRTGDIPLGRATDWVFGNGTDQSDYGVVGYSNSNVTPYGTIQYKDGSEGQISRSASAFEGEKVKRVGTMSQDLVGMVLATDVTVTYTDGITLRHMIEVSNCSVHGDSGGPLFSDETALGILSGGSYVDEPCGDSDPQADRSSFYEPVYKVLLWEGLKIYY

SEQ ID NO: 44375 - protein, 405 aa, Streptomyces violaceusniger Tu 4113
MSHKRVPKRKIVFAGAGVAAVAAAAILLPNANASQDDKTEAAQPKKVDAASAADIAAQLASQLGEAFGGAYYDKDKQQVIVNVVGDNNNVNVEVKSAGAVARSVDNSTKALQTAAKTLKTKATIPGTAWSVDPKTNELRVTADSTVTGAKWDTLESTVKSLGDGMATLKKSTGEFKPFVAGGDAIFGGGARCSLGFNVTTDSGAPAFLTAGHCGVAAEQWSDSQNGAPIGTVQDATFPGDGDFALVTYDDANTQAPSAVNTGDQNVDIVGAAEAAVGQQVQRMGSTTGLNDGSVTGLDATVNYPEGTVSGLIQTDVCAEPGDSGGPLFSADGNAIGLTSGGSGDCTSGGETFFQPVTTALEAVGAQIGDGGAAGGGGAADGGAADDGAGADGAGADGAGGAAENG

SEQ ID NO: 44376 - protein, 444 aa, Streptomyces violaceusniger Tu 4113
MVKHMRRGVRRVVRFAAVGALVCGGVMVSQAVPGGSAHGATGSDGSRALTARQTDDVGGRLVSALGTSRTAGNWIGADGRPVVAVTDDTAAGEVSRAGATAKRVRYSMEQLASATEKLRSAPRVAGTAWMVDPKSNQVVLVGDSTVSTARWSRMKDLAAEVGDEVRTQRTTDSFTTRTAGAAPMFTNGSRCSAGFNVTNGQAGFILTAGHCGPPGTPWFTDATGRTKIGTTVQTSFPGNDFSLVRYDNTSLDQSSVLNVGGGQVVRVTGVADPVVGQEVFRSGSTTGLRSGKVTGLNATVNYPEGTVTGLVQATVCAEPGDSGGPLFAQGVALGVTSGGSGDCTKGGVTFFQPVTKALTALGVSIPGAKAQSANPSIASGGQTGAAPGTSGVDDGVSTLDDVVAYAQSLGPGLVVIVVGFAGLLSTLAIRPRSRRYRRYPAGWG

SEQ ID NO: 44377 - protein, 307 aa, Streptomyces violaceusniger Tu 4113
MRTARRTRRRGRLIAAMSGLFTTAALATVGTSAAASSASTAPSTPPPPSTSVSTTASAAASAVEALDVPGTAWTVDERTATLRVLVGSTVPGADLARLDRTAERFRGAVTVERLDGPLRTLLSGGDGIYSSMGIRCSAGVNVQSGATYYLITAGHCTDGNPTWYADSGATTPVGPTTGTSFPGNDYGVVRYTNTAVPHPGTVGTVDVTGTATAHVGQQVCRRGATTGVRCGQVTALNATVNYGGGDIVSGLIQTNICAEPGDSGGPLYAGDKIIGILSGGSGDCSSGGTTFYQPIQEVLSAYGLTVY

SEQ ID NO: 44378 - protein, 147 aa, Streptomyces violaceusniger Tu 4113
MRKTTGAIGLGAALAVSAVLGIGTSGTASAQPAKPQSLYPPSALVLTVGWGADAATTEVQRAVTLSCRPTATGTHPAPAKACAELRSVGGTFGQLRTGAEPGRVCTKEWHPITVTAEGIWDGRRVSYEHTFANNCFKSAAPTMVFEF

SEQ ID NO: 44379 - protein, 392 aa, Streptomyces violaceusniger Tu 4113
MDAPLSGEKRHVATPSGPWHPTAVGPNPPLEGRDLKHRRIPKRRVAIAGAGIAALVATGITLQSANAAPGETQPDTLSVGAAGKLASTLTSSLKSDTAGAYYDAKAKKLVVNVVNKGVVDKVRDAGAEVKVVKHTLAELSKARQTLKEKATIPGTSWSVDPRSNKVVVTADSSVKGAGMATLDKVAGALGDKVEVKHSAGKFSTFIAGGDAIWGNGGRCSLGFNVVKGGQPYFLTAGHCTEAISSWSDSQGGEEIGTNEGSDFPGNDYGLVKYTKDTDHPSAVDLYNGSTQAISKAGDATVGQKVTRSGSTTQVHDGEVTGLNATVNYQEGSVEGLIQTNVCAEPGDSGGALFAGDTALGLTSGGSGDCSSGGETFFQPVPEALQAFGAQIG

SEQ ID NO: 44380 - protein, 301 aa, Streptomyces violaceusniger Tu 4113
MRIKRNAPHNKQARRIALIAATSALVAGAALAAPAAYAGSDGARTFSAAEAKSASDAVLKADVAGTAWYVDKATNKLHVTADSTVSQSEIAKIKNTAGASAHAIEVKRTSGKIQKLISGGDAIYADSWRCSLGFNVRNSSGANYFVTAGHCTDGAGTWWSNSGHSTTIGPTAGSSFPTNDYGLVRYSGSATPQGTVGSQDITSAANPTVGQTVTRRGSTTGIHSGQVTALNATVNYGNGDIVYGMIQTTVCAEPGDSGGPLYAGSTALGLTSGGSGNCTSGGTTFFQPVVEALNAYGVSVY

SEQ ID NO: 44381 - protein, 426 aa, Streptomyces violaceusniger Tu 4113
MPSIDVVVAREILDSRGNPTVEVEVGLDDGSTGRAAVPSGASTGAFEALELRDGDKNRYHGKGVEKAVLAVIEQIGPELVGYDATEQRLIDQAMFDLDATPDKSSLGANAILGVSLAVAHAASEASDLPLFRYLGGPNAHLLPVPMMNILNGGSHADSNVDIQEFMIAPVGAESFSEAVRWGAEVYHTLKSVLKERGLSTGLGDEGGFAPNLGSNREALDLILEAIKKAGYQPGQDIALALDVAASEFYKDGSYEFEGKSRTAAEMTSYYAELVAAYPLVSLEDPLNEEDWDGWKTITEQLGDKVQLVGDDLFVTNPERLARGIDNDTANALLVKVNQIGSLTETLDAVELAQRSGYKCMMSHRSGETEDVTIADLAVATNCGQIKTGAPARSERVAKYNQLLRIEEILDDAAVYAGRSAFPRFKG

SEQ ID NO: 44382 - protein, 237 aa, Streptomyces violaceusniger Tu 4113
MLKSNGKHRRPSKATRIAALTGLAGAAVAAPLIGATSASAASGVQWDQVAQCEAGGNWSINTGNGYYGGLQFSSSTWAAYGGTAYAPTADKASKSQQIQIAEKVLGSQGKGAWPVCGKGLTSGGSPSAPSAPSAPSAPSAPSGSQDQPSASTKSAPAAQPAQPKAQPHTAPERATREQPRGPIKKGDGEYKVKSGDTLGKIAKEHHVKGGWKKLFKLNDDIVEKADLIYPGQKLHLG

SEQ ID NO: 44383 - protein, 338 aa, Streptomyces violaceusniger Tu 4113
MRSGNGRHRRPRQAPAIIVAAGVTGASIALPLFGASGAQAAQTATWDQVAECESGGMWSADEGNGFYGGLQLTLDMWKDYGGTEYAPRPDLASRSQQISVAQSILGDRGPDAWPSCALGAGLTDGSGAPDVDPGGTATRDPGAGRGETGGRERDGSSSPESDRSGTSDGAGKPDSSGSAEKPAAPHTSESPDGLDGSASDTPTSDGSASDDPTSDGSDDPADSASDGSKGSSADPSADPSPSGRHRGSPDAGGRAEDGDSADGQPSGRHASRDAVDRDQGPTGDDYTVRPGDNLSGIAEDRNVSRGWEGLYESNEDLIGIDPDLIIPGQRLDLTIREQ

SEQ ID NO: 44384 - protein, 778 aa, Streptomyces violaceusniger Tu 4113
MLHSRSSRRLLLAATLVAALVMPLGQAAAAAPRDLAPSAQPWQPKAAPKPPPRPAGNRFDHAQRLDTTPELSAPPVPAPRSVTTDGRIPGPLSGPATPHHDKKPAVAPCTLDGITGLNPDQLADFLADPAVTADGCLRGLVWNWDPRLVPVMSDAHVQTVARRIASLAPGHDGENTSHLYEMFTYLHAVAYHDFSHDEIDTTDAPTVNAVRGAVDAFGAAARTFDATRANADTLREALIACSGPGGRQYQLGLVKKVLATMDPEHTATDKDQSWGNAALSALSLNYLGVYSGNQDKEFQAAVAADPGYRAAFKAFADYTHLKDTPNAWVVRDALLEYGRFGEIDALEQQTITDLGALLPVTVQNFGEGSAPWGKVVSWLITFEACKPYGVCKEDIEKRIFPNTYSYDNGGIKVRTALDRATVDQLYYASKQVRAQFNRVLGTEEPLAGDPNATLVIVLYASRSDYEVYHPMLTGMGTDNGGVYIEQGATFYTYQRRVPQDSSLTLEELFRHEYTHYLNGRFAVPGFFGEGPWYEGDRTTAMDEGSAEFFDGSTRDDGIRVRQSLVRDIISDTQGGRPRMTINEMLHATYSGDGFRFYSYAGTFFEFLWRDHPAKLQEMYRFIRADDPAAFDNWRNQQGADVNLQQQYNTFLDQQIAIVDDLYVPDTTFVPNQDLTLTDAAGAQSAFSRATGNQPVCKDNGDGEHGRFVCTGEITANLSDPGSLNKVFTEMSEAVDANLLDRSKPAAVDFSDMNCSFGRPTVTGNSGTADFSCEGPLRR

SEQ ID NO: 44385 - protein, 361 aa, Streptomyces violaceusniger Tu 4113
MRRLLPQAMVVAALAGGTSAFVAQDKAVRLSVDGDARTLHTYADDVGELLADQDVRVGEHDIVAPAPGERLANGDEIAVRYGRPVTLTLDGERRRVWTTAHTVDDALRQLGVRAEGAYLSASRSAAITSRGLLLHVRTERTVTFLADGREHTIRTNAATVGEALAATGLTLRGQDTTSVPQDSFPRDGQTVTVMRITGGKEVRDEPVPFTTVRRADPTLPKGTELVARPGEPGTLRTSYRVRSVNGVRQRPRKIRSEIVEPPVARIVRVGTMTVPARVGGPADGLDWRAMARCESGGRADAVDGSGHYGGLYQLDQGTWRDLGGHGRPQDAPPAEQTYRAKKLYQQRGTGPWPTCGRKLQH

SEQ ID NO: 44386 - protein, 221 aa, Streptomyces violaceusniger Tu 4113
MSLRKLALSATLGLGLAAALSAVPASAATPDHSTTQRSAAAAGYTASGEEKADTDAFIKAVMKSALAKQAKAPRGAAAVTVTYDASQAPTFQSQISRSAQIWNSSVSNVKLQAGSNADFTYREGNDPQGSYASTDGHGSGYVFLDYAQNQEYDSTRVTAHETGHVLGLPDHYEGPCSELMSGGGPGPSCTNSQPDQAEISRVNQLWANGLAKLEKQLAKSH

SEQ ID NO: 44387 - protein, 975 aa, Streptomyces violaceusniger Tu 4113
MSSGIRRRSLLSAAALGSTAGSLGLLVPASAQPVLGAEPSAATLPAEDGYDLWLRYRRVEDPGQLKRYRAALGTLVRQGGGPLQQSAVEELVRGLSGLLGTRVAPRTSAPLHAALVVGTPTSSPLIRELVPAADVAELGDEGYVVRRVTRRGRDFTVVAAHADRGVLYGAFHLLRLVQTRRPLEHVDLTERPAAPLRMADHWDNDDGSIERGYAGRSFFDWKKLPQLDTRYTDYARVLASLGINGAVINNVNTPADYLAEPFLTKLAALAGVLRRYGVALYVTANFAAPIDLGGLNTADPFDPGVRGWWTKKAEEIYGKIEDFGGFLVKANSEGRPGPLDYGRTHADGANLLAGALRPYGGIVMWRAFVHDTDEKWDRQAYLDFTPLDGKFADNAVVQIKNGPIDFQVREPAHPLFGSLPRTNSMIELQVTQEYTGHATHLCYLVPQWKEVLDFDTLKAGEGSTVAHVVTGRVHSYTHFGFAGVMNFGDARNWTGSHLAAANTHGYGRLAWNPDLSAQDLAAEWTRMTFGNDPHVIETVSTLLLDSWHTYEDYTSPLGTGYLTHPPDASVTGHFDPSPTTTSQFHKSDRAGIGYDRTAATGNGYTELYAQATRDTYESLENCPEELLLFLHHVPYTHRLDSGTTVIQHIYDTHFSGAARVADMRTDWEGLRRRVDHRRFTAVHRRFGEQITEAAKWRDTLVAYWFDLSRIRDERRAWLQAIVAPADTVLLGGERNELPVQVLNATGAGLRTVTTLDVPEGWRSEEATAYVASREGATVKMPVVPPPTPALATLHARPRSGVVPVLDSSLRSLARAVVVPPAARCVHALDAGPDSAPLLKDYTRLSPSSSWHEGAGFGWVGNTPDATDTGLFDVVRRDYVRDSAPTVLRLKLPAGRCTAHLLTGDPNTLNRSLIVRVDGSEKARSEQLDGREFAWLRIPLDGGSSGREVDLELSAKEDETWHLSACVVVADDQRPS

SEQ ID NO: 44388 - protein, 385 aa, Streptomyces violaceusniger Tu 4113
MTVRGSHRRPASPSRISPLCAALTAGGVGIVLPLLVTGPAHAASAGTWDRVAKCESGGNWHINTGNGYYGGLQFSQHTWAAFGGTAYAARADLAPKAQQMTVAEVVLSKQGPGAWPVCSVRGRLSWSGPPAEVASRSAEPRAEHPAEPAKKSAKSAAKSRARQHTARRAASGSYAVVRGDTLSRIAARASVSGGWKALYHANRGTIGPNPHLIHPGQRLALPSGARHVRKAAPRHRASAISSHTVVRKAAARPHMAPVGGTVSAAYGIRGARWASGRHTGVDFAVPIGTSVRAAAPGTVVAAGWSGAFGYQVIIRHADGLYTHYAHLSALTVRTGQSVEAGGRIARSGNTGNATGPHLHFEVRTGPHYGSDIDPLAYLRSRGVSV

SEQ ID NO: 44389 - protein, 412 aa, Streptomyces violaceusniger Tu 4113
MPLRGRHRRYKPNRISRASLSVTAGGAGIALPLIGAAGASAASGETWDKVAQCESTDNWDVNTGNGFYGGLQFTQSTWEAYGGSAYAGRADLATKDQQIAIAEKVLDGQGPGAWPVCSGKAGLTQGDAAPQTAPKIVKTAAAPVKKAQRPEKAQQVAASKPTPTSLPGHNSTKSGHYVVVGGDSLSGIADSHDVTGGWEALYESNREAIGGDPDLIYPGQKLSLKGGKATAKPKAEPERHHQTKEKPKPKPKAKPAPQPKAEKPHNSREQNTKRVASSGFTAPVSGVNPSTAYRAAGSSWSSGYHTGVDFPVGIGTSVKAVGTGHVVSAGWGDAYGYQVVIRHPDGRYSQYAHLSQLSVRAGQSVNGGQQIGRSGSTGNATGPHLHFEIRTGPGYGSDINPLAYLRSHGVSL

SEQ ID NO: 44390 - protein, 327 aa, Streptomyces violaceusniger Tu 4113
MNHTPASAGTTRIPGRRRRTPRSMAAALLGGVLPLLASLFLLAPTPAAAASLTEVTGFGTNPSNLRMYEYVPDNVAARPAVLVAVHYCTGSGPAFYSGTEFASLADRYGFIVIYPSATRSGACFDVSSPQALRHDGGSDPVGIVSMVRYAQQRHNADPNRVYVTGASSGAMMTNVLLGDYPDVFKAGAAFAGVPFGCFATTDGSGWNSACANGTITKTPQAWGDLARGAYPGYQGARPRMQLWHGTDDGTLRYPNFGEEIKQWTNVLGVSQTPVLTDRPQPTWTRTRYGATGNQAPVEAISVQGTGHSLPAAGMAARAITFFGLDAG

SEQ ID NO: 44391 - protein, 310 aa, Streptomyces violaceusniger Tu 4113
MFSLVRSRVRTAAFALTAVAALAFGGTAATAATGTAAAPAPAPAKQGPTSVAYVEVNNNSMRNVGKYTLANGGGNVFDVAVIFAANINYDTGTKSAYLHFNENVQRVLDNAATEIRPLQQKGIKVVLSVLGNHEGAGFANFPSQQAASGFAKTLSDTVAKYGLDGIDFDDEYADYGNNGTGQPNDSSFVHLVTALRANMPDKIISLYNIGPAASRLSYGGVDISSKFDYAWNPYYGSWQVPGVALPKSKLSPAAVEIGRTSQSTAASLARRTVSEGYGVYLTYNLDGANRGADVSAFTRELYGSDAVYTP

SEQ ID NO: 44392 - protein, 229 aa, Streptomyces violaceusniger Tu 4113
MTRTHAVLAHRWRTIALACWLVAMTGVVLLVWARISAADHRGDQLRTEADRRGAAVSTLATDVRQLRSQVKAEGKTPVAPDPSEAVKDLPDRAEVPVPIPGPRGPSGPPGKADDGTDGANGKNGQDGKDGAPGTPGADSTVPGPAGPAGPEGPQGPAGPPGKDGQDGAPGTDGKDGRDGQTCPDGYSLQPPPDDPDALVCRRNGAPDPAPDPGTSPQTPAALAPDRRRM

SEQ ID NO: 44393 - protein, 301 aa, Streptomyces violaceusniger Tu 4113
MWRRRVLAPLAATAAVCASVLVMPMASSASAAGTTAQAACDYPNWAAGRAYVTGDIVRYTDGKYYRAEHDNPGYDPVISTWYWEPFNCGGEGQNPSGFVVSEAQFNQMFPNRNSFYTYQGLTAALSAYPGFANTGSDTVKKQEAAAFLANVNHETGGLVHIVEQNTSNYPHYCDSSQPYGCPAGQAAYYGRGPIQLSWNFNYKAAGDALGIDLLGNPWLVEQDAAVSWKTALWFWNTQTGAGSMTPHDAMVNQRGFGETIRAINGSLECNGGNPGQVQSRIDAYQRFVQILGTTPGSNLSC

SEQ ID NO: 44394 - protein, 288 aa, Streptomyces violaceusniger Tu 4113
MSPMPRRIGLAAVAVAVPAALVFTGVGVGQASDHLPSSADVHRHSAHKAAAASNLDDPAKKEIAMKLVSSAENSSLDWRAQFQYIEDIGDGRGYTAGIIGFCSGTGDMLELVEYYTQQKPGNVLAKYLPALRDVDGTDSHDGLDPNFTKDWKKAAADKAFQDAQEHERDRVYFNPAVKQGKDDGLGALGQFTYYDAIVMHGPGDSKYSFGGIRKTALSKAKPPAQGGNETTYLNAFLDARKEAMKSEEAHSDTSRVDTEQRKFLNEKNFDLTPPLQWKVYGDPFEINS

SEQ ID NO: 44395 - protein, 391 aa, Streptomyces violaceusniger Tu 4113
MSRRRRHGLELAAGCTVAIAALLLGSGIPAVANPGEPSPRPRREVPPEMLASMQRDLGLTADEARTRISNEYRAGATEPGLRKSLGGSYGGAWVTGNTAELTVATTDEQQSGTITAGGAKAAVVKHSLKALTDAKQALDRTASERPPAADVASAWYVDVKSNSVVVQSAEPSEAAAFVATSGADREVVRVVESAERPSPLYDLRGGEAFYINDAARCSIGFSVTQGEQNGFVTAGHCGSQGDTTTGFNQVAQGSFQGSSFPGHDYAWVSTNADWVPQPWVIGPGSTNVTVTGSQEAPVGSSVCRSGSTTGWHCGTIQQHDTSVQYPQGTINGVTRTNVCAEPGDSGGPFISGSEGQGITSGGSGNCTVGGTTYYQPVNPILTTYGLTLTTG

SEQ ID NO: 44396 - protein, 559 aa, Streptomyces violaceusniger Tu 4113
MSHRRVNKRTLAISGAAVAALGAAAILLPNANANPDKTSGAKTFSSPVAVKLARSLAADLGDNGAGWYYDNASRQLVMNVVDEDSAEGVRAKGAVAKLVTNSMEDLKAATKTLSSDASVPGTAWSVDPVTNKVQVTADRTVTGAKWATLTKATDQMEGTVSVKRSQGEFKKFDGGEAAQPGDNGGAGVGDAAGAGDAAGNAGAAGGAGGAGAGAAGGADDAGAGGAGDAGAGGAVGGEQGAGGAGDAGGAGDAGGGGDAAAGGLDGGDAIFGGGARCSLGFNVSVDGAPGFLTAGHCGNASQTWTSDEAGAQQVGTVQDSQFPESDFALVMYDDATTQASSTVDLQDGSTQEIGRAVEASVGLKVQRSGSTTGVTDGTVTGLNATVNYGNGDIVNGLIQTDVCAEPGDSGGAMFAEDAAVGLTSGGSGDCTQGGETFFQPVTGALEATGAVIGAGGGGDAAGGAGDAAGGAGDAAGGAGDAAGGAGDAAGGAGDAAGGAGDAAGGAGDAAGGAGDAGAVGGGGDQGAGGAGDASGSGDPGAGAAAGAGDTGSDAGQGLN

SEQ ID NO: 44397 - protein, 339 aa, Streptomyces violaceusniger Tu 4113
MPVPPRQALPRSRWSRIAARLLPVAALVLGAVLAGPAPAANAAVTLTKVGNFGSNPGALNMYVYKPASLPANAPVVVALHGCTQSAQVYADNSGLPELADRDKFVLVLAETTSSNNLTKCFNWFQAGDNRRDQGEALSIRQMADHAVSAYGGDSKRVYITGLSAGGAMTSVMLATYPDVFSAGAVVAGLPYNCTKNTSPYLCMNPGLDLSPGEWAQRVREAYPSYEGPWPRTAIWYGDRDTTVVPRNATELRDQWTALHGLSQTPTRTSSIGPNATQHDEYVTSDGTVAVEVNKVPGINHGTPVDPGTGAEQCGSTGAPYFLDSICSSYWITKFFGLGG

SEQ ID NO: 44398 - protein, 487 aa, Streptomyces violaceusniger Tu 4113
MSPPRTACAPPGGRPGRRAARGVLSLVGACSLVFAWVAAVPAAGAEGTPGGRCSGYALPHVPGAAHQQADCLDELTTAGTVASGHTDPADFAGLTPKDLPTPSGVPGIQIDGYFPDTSATNTNHGWNHDAQFVIRLPDHWNGGLVVSGTPANREQYANDRAISDWVLSRGYAFAATDKGNTGPTFYRDGRRPGDAVAEWNKRVTQLTRAAGAVVTQRYHRPPVRTLATGMSNGGYLVRWQLENHPELYDGGVDWEGTLWRTDGPNPLTFLPPALRAYPAYAAGGAGAEDAWKAMRKAGYPAGSEFLWPYHHKVYWDLTQRIYREEADPDFDGATEAGTPYCAPGTPGCDADYDYATRPPAVHRAVDRIALTGRIGKPLITLHGTLDALLPISKDSDVYARMVHRAGRGALLRYYRIEDGTHVDSLVDAHPGKLRPIVPCHRSAFAALEQWLTGSGRPPADHTVQRPADADPATLLTSCPLDQGVYRK

SEQ ID NO: 44399 - protein, 858 aa, Streptomyces violaceusniger Tu 4113
MPLSRRALVSTLPAATLSAMALPLHARAAGRPATYGETADGETSGAAHTRLIDNTVAVFAGTREVGARPDVRAKLAAIAATARSRLNAMDRAGQGELFEGLALGTSDPNLITSFQYLYEIALATRTPEGGTRSGLYGDTGVQRRVIDSLIWLHEHYYGDQSKGYYGNWFTWEIGISTHVSKILALLVDQLAAYQPELAATYVTSMDAYLRNGKAGDVDLDSRFHTGANLADITTNRILQGAVLGDDARITKAIADQLTVLATIDPYALRHGVTDGFYADGSFIQHASVAYTGSYGKGLLTRVVQTLKMLDGTGYTTDDRLVRVAQGWVVDGFAPLIFEGWLMEIVKGRGVSRPATGYADAAEVVEAVVGLSAHATGADATALKGYVSYLRQTSKATLDPSAFVSPVSIARYADILADSSIPARDLGPAERHVAFNAMDKTVHRRPGYAFALSRSSSRISRYEYMSGENLMPWFQGDGAHHLYLSGQDQTQAFGIDYLTTVPPHRLAGVTAPVETRRTIPELYGTLWYDNPERGFTSSSEAQNTYVYFPRGTHPFSGGAALGAYGVAGLVQSDDVAYAAKQAGDLPDDFVVYRNADATKSWFLFDDEIVVLAAGVGDAAGRAVTTTLDTRIAAPSDTLALTGRLRGGAPWSGTGTAPLAWLRYANATRAASVGYVFLDGPPPTVTLDTVTRSRRAVRLANPDLPVTKQLFAVTVERPAGAPHTSMAYALVPGATERQLGTYARRPLTVLANTTRLQAVAHRGLRIIALNAFTPGTHRAGRLSVRGPGSVLLREARDGALTIAVSDPTTERDTVSVVIRGRRMRAVAADDGVRVGRVPGGTRLVVTTRHAYGRSFTATLR

SEQ ID NO: 44400 - protein, 209 aa, Streptomyces violaceusniger Tu 4113
MHRSIASTAAAVVLAAALVACGGSDGDSNKAAATKSAGSSGATTSGGQQTPDATPGSTTPSSAKVGDTLSLEGLPGMGATGNNVQADITLTKYEDHAKPSLEAFAAPDGQRLVAAEFTILSTGDATYDDPGNLGAKVIDSTGKVYPGKPGIPTAGDSLDLTMILQPGDKTTGWVVFNVPQDAKITAVTYQMDSLLQTNGEHTGRWTLLA

SEQ ID NO: 44401 - protein, 111 aa, Streptomyces virginiae
SLYAPSAMVFSVAQGDDVAAPTVVRATTVSCAPGARGTHPDPKAACAALKSTGGAFDRLLSEPNPDRACPMHYAPVTVSAVGVWEGRRVAWDHTFANSCTMAATLDGNAVF

SEQ ID NO: 44402 - protein, 360 aa, Streptomyces viridochromogenes DSM 40736
MKHRRISKRRAAVAGGGIVALVAAGVTLQSANASETPEASAPKTLSIVAAGKLASTLAQDLGGDAAGTYYDTKSKSLVVNVLDEAAADAVEKAGAKARIVANSLAELKSARSTLKADATIPGTSWVTDPTTNKVVVTADRTVSKAEWSTLTKVVDALGAKAELQRTKGEYKPFVAGGDAITGGSGRCSLGFNVVKGGEPFFLTAGHCTESISTWSDSSGKKIGTNADSSFPDNDYGLVKYTADVAHPSEVNLYNGSAQKITGAAEATVGMKVTRSGSTTQVHDGKVTGLDATVNYGNGDIVNGLIQTDVCAEPGDSGGSLFSGDKAVGLTSGGSGDCTSGGETFFQPVTEALSATGTEIG

SEQ ID NO: 44403 - protein, 301 aa, Streptomyces viridochromogenes DSM 40736
MRIKRTTPRSGISRRTRLIAVSTGLVAAAAIAIPSANASDTPSTFSAAELKSASGSLLKADIPGTAWAVDSKNNRVLLTVDSTVTQAEIAKIKQQAGGNADALTIKRTPGTFNKLIQGGDAIYASSWRCSLGFNVQNSSGQQFFLTAGHCTDGAGTWYSNSGRTTVIGSTAGSSFPGNDYGIVRYSGSVSRPGTANGVDITRAATPSVGTTVIRDGSTSGTHSGRVTALNATVNYGGGDVVSGLIQTTVCAEPGDSGGSLYGSNGTAYGLTSGGSGDCTSGGTTFFQPVTEALSAYGVSVY

SEQ ID NO: 44404 - protein, 211 aa, Streptomyces viridochromogenes DSM 40736
MSECADTTRDNARKNQVRTTAVLAGAALLAPLGLLAATGNAAAADSGVWDRIAQCESGGNWHINTGNGYYGGLQFAASTWSAYGGTAYAATADQASKSQQIAVATKVQRAQGWGAWPVCSARAGASGGAPASADPVTTTKSAPAKPSKAPARPTEHADRSSSRGDYTVRQGDTLSGIAARHGTTWQRVYDANKAAIGGDPDVIVPGLSLEL

SEQ ID NO: 44405 - protein, 532 aa, Streptomyces viridochromogenes DSM 40736
VDPAWLPAAAFRAIGGRRTLVRGPDPLVETVHGEVAEACRRFGGRVARAASDGSYHLVLGLGDDGLGEEGFTVARSGGATTVTASGPRGLLYGLFHVVRLGEAAFRGEWAPETHRPAHALRMLDHWDNVAVHPVMGQVERGYAGGSLFWEDGRARGELDRVRAYGRLLAACGINAISVNNVNVHATEARLLTDRIGEVADLADALRPYGVRTHLSVSFAAPIVLGGLPTADPLDASVRDWWAGATRRVYEAIPDFGGYVVKADSEGQPGPFAYGRSHADGANMLAAALEPHGGTVHWRAFVYDHRQDWRDRTTDRARAAYDHFVPLDGEFAANAVLQVKHGPMDFQVREPVSPLIGAMPRTRLAVEVQATQEYTGQQRHVCWLGPMWSEVLRFRHEQDITVGELARGGLVAVSNAGDDPFWTGHPLAQANLYTFGRLAWRPDAEPRAVLDEWIGLTFPDAPSPLADGLHAVLDGSWRTYEKYTAPLGVGWMVQPGHHYGPSVDGYEYSPWGTYHFADRDGIGVDRGAATGTG

SEQ ID NO: 44406 - protein, 277 aa, Streptomyces viridochromogenes DSM 40736
MTAPAEQRVRHRRRVTRRRAVISGLSAFGIAGAAIVTTSMLSTASAASSWPSDTGSEPVSKTIPVSGVRDGGMKMFYGTGALGKDNQDEGQDPLFELADGATLKNVIIGSPAADGVHCKGSCTIQNVWWLDVGEDAASFKGKSSSAVYKVIGGGAKNADDKVLQFNGAGTLNVSGFQVENAGKLVRSCGNCSTQYKRTIVLNDIDVTAPMNAIVGVNQNYGDTATLSKIRVHGDSKKKIKTCVRFEGNNTGKEPKELTPPGPDGKTCNFKASDISYQ

SEQ ID NO: 44407 - protein, 353 aa, Streptomyces viridochromogenes DSM 40736
MGQSHPPFRFTEGRRLIGGIRRWVTATAGALALTGGLIAGSPQASAAGLTQVTGFGTNPGNLSMYTYAPDGLPADAPLVVALHGCTQSANDYYAHSGWPKFADTFGFALVFPQTSSANNANSCFNWFEPGDSSRGQGEALSIRQMVDKAAALYGSDTRRVHITGLSAGGAMTANMLAAYPDVFAGGAIGSGLPARCASGVAAAYTCMYSPPDKSPARWGDLVRSAAPAGTSSWPRVAIWQGTADTTVKPANATELRDQWTNVWGIGQTPSRTESLGGGATLSVYDDVSGRPAVEVYSVAGMGHGLAVEPGGGAEQCGSTGTYYLDTLCSSYHTARFWGLDDDRSTAALPAPTG

SEQ ID NO: 44408 - protein, 183 aa, Streptomyces viridochromogenes DSM 40736
MLTGGLAAACLVSMSLTGAQALAAPHDTAGSPLAAHVLTYDAAGSAEFRSAVDRGAAIWNESVDTVELRPAASGQRANIRVLADNGWPRALPTTLGNGTVYIGRQAVDQGYNTIRISAHELGHILGLPDRKPGPCSSLMSGSSAGTACTNPYPNTAEKAEVEGNFGGLLVGRAPAPGAGLIVD

SEQ ID NO: 44409 - protein, 278 aa, Streptomyces viridochromogenes DSM 40736
MFGGTVRHPATPAARRTVLALFGAALVATPLLKPPHAAASVRAVGLDDPAKKEIAMRLVSSAENSSLDWKAQYPYIEDIGDGRGYTAGIIGFCSGTGDMLDLVELYTDRKPGNVLAKYLPALREVDGSDSHDGLDPGFPGDWRRAARDDVFRRAQDDERDRVYFDPAVRQGKADGLRALGQFAYYDAIVMHGDGSDPLSFRNIRKRALRTAKPPAQGGDEVTYLGAFLDARVWAMKQEPEHDDTSRVDTAQRVFLRKRNLDLDPPLDWKVYGDSYHIG

SEQ ID NO: 44410 - protein, 455 aa, Streptomyces viridochromogenes DSM 40736
MVHRHAVTGRRAALTVLGVLVATGIPSAVAAEPAPPAGPQPSAAQTLGADRPPAPVVHAMERDLGLTAAQASLRLVNEAEAGTRAGRLRNALGSRFAGAWLRGTTSQELFVATTQAADVPAIKAQGAKAAVVKRTLRDLGAAKRKLDAAATRVSTRDTPLWYVDVPLNRVTVQARSKAAAAAFVKAAGLDGKSVGVTVTASRPRLLTDLTGGDAYYINGAARCSVGFSVTKGTQQGFASAGHCGRTGDSTTGYNNAPQGTFQASTFPGRDMSWVAVNDQWTATANVKGEGGQNVQITGSVQALVGAAVCRSGSTSGWHCGRIEQHDTSVSYAEGRVDGLTQTTVCAEPGDSGGPFVAGTQAQGVTSGGSGDCASGGTTFYQPINPLLSQYGLTLKTAAAAAAAPQENAAPTWTAGRVYEAGATVTHAGVRYQCLQTHQAQAAWAPTGTPALWQRV

SEQ ID NO: 44411 - protein, 296 aa, Streptomyces viridochromogenes DSM 40736
MSRRRVSAVLATLVLAGTAPVLLPASSASAAACSSYPSWVAGRSYAAGDIVRYTDGKAYIAEHANPGYDPTISTWYWEPYACDSGPGTPNARFVVSEAQFNQMFPNRNAFYTYSGLTAALSAYPGFANTGSDTVKKQEAAAFLANVGHETGGLVHVVEQNTANYPHYCDWNRPYGCPAGQAAYYGRGPIQLSWNFNYKAAGDALGIDLLNNPWLVQNDAAVAWKTALWYWNTQTGPGTMTPHNAMVNGAGFGQTIRSINGSLECDGKNPAQVQSRVSNYQRFTQILGTSAGGNLYC

SEQ ID NO: 44412 - protein, 409 aa, Streptomyces viridochromogenes DSM 40736
MAVRGRHRRYQPNRINRASLTVTAGGAGMALPLMGAGTAQAADVGIWNKVAACESSNNWDINSGNGFYGGLQFTQSTWEAYGGRAYAARADLAGKDQQIAVAEKVLDGQGPGAWPVCSVRAGLTRGGAEPEIRPAAERTGKHAKKKAKTSIEDVRPQSTPQARAGSAEMYTVVRGDTLSGIAQEREVRGGWRGLYAANRSAIGADPDLIVPGQRLALRGEGATKTRPASERVPSAKPSPKKPSSKKPSTSRTDERAKERSKGESKERAARSTTTRQGLVAPVSASLGTPYHKAGSAWSKGYHTGVDFPVPTGTSVRSVAAGSVVSAGWGGSFGYQVVVRHGDGRYSQYAHLSAISVRDGQTVSAGQRIGRSGSTGNSSGPHLHFEVRTGPGFGTDVDPIAYLRAAGVRI

SEQ ID NO: 44413 - protein, 132 aa, Streptomyces viridochromogenes DSM 40736
MISSQNAETISTRDGRRHRLSPALVLLVTAAILGVATRAEALPPAPSGTDWDAIAACESGGNWKANTGNGHYGGLQFKQSSWVAAGGLKYAPRADLATRKEQIAVARRLAALQGMSAWSCARVRADALRDDW

SEQ ID NO: 44414 - protein, 474 aa, Streptomyces viridochromogenes DSM 40736
MWERFHEGHAHVTMLSICWTPHHAPRAAPHDGRDTGVSATAHPTARRPLRSMLLALVAALLPLLAATVLTAPVAAARERAVPAAALTEVTNFGTNPSNLRMYLYVPQSVTPNPAVVVAVHWCTGSGPDMYNGTEYDTLADRYGFIVLYPSVTRSSKCFDVSSPQALRRGGGSDPVGIKSMIDWVTRTYDADTDRVFATGISSGAMMTNVLLGDYPDVFAAGAAFSGVPFACFATTDGSEWNSACSGGTVTHTPQQWGDLVRNAYPGYSGPRPRMQTWHGTQDDVLRYPNFGEQIKQWTNVQGVSQTPAATDTPQSGWTRTRYGGTGDQAPVEAISLQGVGHNLYAQGMASRVLTFFGLDKSGPAPQPQPGACKVTAGVNAWSTGLTASVTITNTGTTTVDGWKLGFTLPSGQTVTGGWGATYAPSSGAVIATNVSYNGTIAPGASVSIGYQASHGGNSAAPAAFTLNGTACAAG

SEQ ID NO: 44415 - protein, 262 aa, Streptomyces viridochromogenes DSM 40736
MTSATRPRARRRALAGALATLGLSVGMIMTTNAPAASAATWPTPNGSQGTSSTISVSGTKDYGMKRFYGTGDLAGDGQEEGQDPIFKLADGAVLKNVILGAPAADGIHCEGSCTLQNVWWEDVGEDAATFRGGNGATYQVIGGGAKKAADKVFQHNGGGTLTISNFAVQEFKTLYRSCGDCSTQYTRKVNLNSIDVTGTGSTARIVGINVNRDDVATLRGITIRNDSGRKVVPCQKYNNNTAVGSGPDSKNCLYSTSDITYR

SEQ ID NO: 44416 - protein, 144 aa, Streptomyces viridochromogenes DSM 40736
MRNTARWAMTLGLTATAVCGPLSGAALADPGQAPTALYAPSALVLTVGHGESAVAATPERAVTLTCFPKASGTHPVAGSACAQLRGVGGDIRALTAGEGAFCTKQYDPVVVTVDGVWQGQRVSYERTFSNECVKNAHGSGVFAF

SEQ ID NO: 44417 - protein, 470 aa, Streptomyces viridochromogenes DSM 40736
MSHKRIPKRKAAIAAGSVVALGAAAILLPNANASQDGSSDDAAAAPKTLKAGDASDLASQLSGLLGEAFGGSYYDGDSQQLVVNVVPGDNNNVIVQAKAAGAKVREVENSWSELQDGASTLKSEATIAGTSWSIDPRTNKLLVTADSTVTGAKWDRLESTVKSLGSGMATVKKSSGTFKPFVSGGDAIFAGGSRCSLGFNVTAGDGSPAFLTAGHCTLGGNEWSDSQGGQPIATVDQATFPGNGDFALVKYDDPATEAPSEVNTGDQTVQITEAAEATVGQQVFRMGSTTGLNDGQVLGLDATVNYPEGTVTGLIQTDVCAEPGDSGGSLFTQDGLAIGLTSGGSGDCTAGGETFFQPVTTALEAVGATLGAGGAGAGAGGEAGAGEEGGAGAGAGEEAGAGEEAGAGGEAGAGAGEEAGAGEGAGAGEQAGGEEAGAGAGQDAGAGQDAGAGQDAGQGVEDNSGLTESR

SEQ ID NO: 44418 - protein, 446 aa, Streptomyces viridochromogenes DSM 40736
MRHARRRVVRRVTRLAAVGGLLLGGAMVTQAVASEPPDPTIGLPYSAGAATSKGTDLVSSLGTSRTAGNWVDSAGKPVVAVTDEEAAAEVKRAGARAKMVRHSMSDLKSAAATLRSAPRVSGTSWALDYKNNQVVVRGDSTVSASDWSRMTEVAEGIGGFVRMERTEGTFTPRLNGALPILSTAGRCSAGFNVTDGKSDYILTAGHCGPDGSVWFADDRGRDQVGTSLKGSFPGDDYSLVKYAGGRAGKGAEVVSVGDGEGVRITGVADAEVGQKIFRSGSTSGLREGEVTALNATVNYPEGTVTGLIETNVCAEPGDSGGPMFADGIALGVTSGGSGDCTAGGTTFFQPVTKALTELNVKLIVSKQAGGAGPARSASQGTASPGSSAPVTGEGVSSLLTRLTDPRNVGPGMLVIAGSLVALVATRWIRAEQDRKAYRQYYSATWG

SEQ ID NO: 44419 - protein, 429 aa, Streptomyces viridochromogenes DSM 40736
MPSIDVVVAREILDSRGNPTVEVEVGLDDGSTGRAAVPSGASTGAFEAIELRDGDSNRYLGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKSKGLATGLGDEGGFAPNLGSNREALDLILEAIKEAGYTPGEQIALALDVAASEFYKDGSYTFEGKTRSAAEMTEYYAELVDAYPLVSIEDPLFEDDWEGWKTITDKLGDKVQLVGDDLFVTNPERLARGIEENAANALLVKVNQIGSLTETLDAVELAQRNGFKCMMSHRSGETEDVTIADLAVATNCGQIKTGAPARSERVAKYNQLLRIEEILDDAAVYAGRSAFPRFRSANQ

SEQ ID NO: 44420 - protein, 230 aa, Streptomyces viridochromogenes DSM 40736
MLFSSNGKHRRPSKASRAIAVAGVTGAAVAAPLMATGSASAATTSEWDTVAQCESGGNWSINTGNGYYGGLQFSASTWSAYGGTQYASTADQASKDQQIQVAEKVLASQGKGAWPVCGKGLSGASTGGGSSSDSGSSSQQSQQQSTESRETQQPASRSDERPAAKKTVTTPTGKKVKKGDGEYKVVKGDTLSSIAEEKKVEGGWEKLYQLNKDIVDDANLIYTGQQLHLK

SEQ ID NO: 44421 - protein, 317 aa, Streptomyces viridochromogenes DSM 40736
MLSGNGRHRRPRQAPALLLAAGVTGSAIAIPLLGASGASAADGTTWDRVADCETGGAWSQNSGNGYYGGLAISQDDWENHGGLDYAASADLASRSQQIAVAERILADQGVGAWRTCGLLSGLEQGKGSDSSDSSDSSGSTDSSGLLDSLGSSPSGDPSSSPSSPDTSSASKGEAGESGKSGESAESSQKQQPGSSPSATPERDTSNSERGDGSSAPTDTGSGRHRGPSADETSTPESGRTDESTGRHASRGDEGSRDASEGAYIVGVGDSLWSIADSLDISGGWHELYDGNKKAVGDDPDLIRPGEKLAVEGEADEK

SEQ ID NO: 44422 - protein, 459 aa, Streptomyces viridochromogenes DSM 40736
MPGLPRQGPTGAAPAPAFTVGPPRVGPRPEPRTEPRLEPRTEPRPESRTEMPAGSRVEARAEARAEARAGSRTGARTGSHRRSARRRKTRYVERPGDGSMRRLLPQALVVAFLAGGTTAFVAKDKAIELNVDGKARTLHTFADDVTELLAEEGVEIGAHDVVAPGPGARLTSGDEIAVHYARPVRLTLDGDRREVWTTAHTVAGALRQLGVRQEGAYVSASRAQRIGRAGLALDVRTERTVTIMADGRARTVRTNAATVLDAVEEAGITLRGQDTTSVPQGSFPRDGQTVTVLRITGGREVRDEPIPFPVRRIEDPALFRGTEVVEQAGEPGLRRVTYSLRTVNGVQQKPRRIKAELVRAARPQLVKVGTKPPPDSVRGADHLDWQGLAACESGGRPDAVDSSGTYGGLYQFDTHTWQSLGGRGRPQDAPAAEQTYRAKKLYVKQGTSPWPHCGGRLHS

SEQ ID NO: 44423 - protein, 383 aa, Streptomyces viridochromogenes DSM 40736
MRRTTALRTGLSALLLLGTWATASALPASAADAPARSTDAPASPELLSAMQRDLGLTRGRAEARLAAEKAATVTERKARSAAGMAYGGSWFDADTGKLTVAVTRAANADAVRATGATVRLVRYDARQLDAAKKSIDALSAPAGVGSWHVDPKANNVVVNVVAEHRNDNVVRAFVARARQAGPVTVRQTRATPRTFTAGTVGGDPYYTGNVRCSIGFSVHGGFVTAGHCGSPSAAAYGWDRSYIGNFQGSSFPGDDYAWVNVGSGWWTVPVVLGWGTVPDQLVRGSAEAPVGASVCRSGSTTHWHCGTVLAKNETVNYSQGAVHQMTKTSVCAEPGDSGGSFISGDQAQGVTSGGWGNCSSGGQTWHQPVNEILNRYGLTLHTA

SEQ ID NO: 44424 - protein, 634 aa, Streptomyces viridochromogenes DSM 40736
NPSTTRIGNGWERGRIGSPGLASRTSRAVCTTVGGARGRRGLAAVDTRLDSTRHRDYSGTSTGANRVDLCRSVALRGILGRAPAKIALARDALSPVFPYVTRGDGLYADGSFVQHTRVAYSGTYGQVVLDGLGRLFTLLAGSDWEVTDPNRQIILDSVEQAYAPLIHDGLVMDSVNGRAISRGYLTTDDRQVMRGDHFHGQQLIAAIALLAAGASPAERDRWHARIKGWIERDTVSPILTARQFGVADLARLHTVAASPVPAAPEPTGHRLFAAMDRAVHRRPGFTVNIAMASDRIAHYECGNGENPRGWHTGAGMVSWWAGASDQYTDWYWPTVDWYRLPGTTVSTKRLADREGGEWGEARPDARWVGGTTDGEYAALGQHLKGLGSTLQARKSWFCVADAVICLGAGISCADGVPVETVVDNRNLGEAGTQRFTRAGNWAHLEDHGGWVLLDGEPRVLREDRTGAWSDINTGSTPERRTRRWQTLWLDHGTDPADATYAYLLMPRASRRAVARRAADRRWLSVLANDAGRQAVTVPSLGCTAANFWRAGTAGPLTASAGASVLTVRRGRTATLCVSEPPRTGRPLEIIWHRPVRGVVRADESVDVLSAGRRLRVRVTPGEACATHVCEVTLD

SEQ ID NO: 44425 - protein, 497 aa, Streptomyces viridochromogenes Tue57
MTQAEAVGEERRELPRYLVDVVEEVCALWDSATLRHVVRRFGRRSRVAVESTEPVARRPLLVQLMEEMCDHQEGLAPLVRHLEVREGNTTGIQRLKVAVAAWEVELFTVEEWNDVFLLLDEVHVPDLRRWYADFLHCRGRASPPIHCTEPWSVFLHAATLNARPGQSLPCFDVLRQLALVADGEQHLALADWADAHDLALTPQGAEHEPAEKTAAALRTDVWSPTSYVIIRLRHLLDSDGDTDILLSYWWRVHPGEQQRGKDRRITLGQAEKAVRALIHNAESEWAYLRSDIAVEFLLPRVLLDLGVERWRKTAFQGVGGVLGEDHHVVLRSLDRHDRRDLHGRWGSRWRAFTEGNAGRVHWFPEDGRAHLLSEPPPAVVVLSEAPGSAQGDAWAHGRTDELGEALRAGVPIVLWDRRGLADPAFRAQLRDLLERHDLRTLPGVVKALRIATADRDAEANAVVGRHVALLWDDPDRMPVGPPSNDQEAARTVVEEGQ

SEQ ID NO: 44426 - protein, 216 aa, Streptomyces zinciresistens K42
MAFSTSARAAAALGLGVAALGLGTAAPASAAPAAEAGYVAKSGATGGDSAFFQAVLKSVAEKRAANPTAAAVTVVYNASGAPTFSAQIARSTQIWNSSVTNVRLQSGSNADFTYREGNDSRGSYASTDGRGNGYIFLDYRQNQQYNSTRVASHETGHVLGLPDNYTAPCSKLMSGGGPGTSCTNAQPDATERNRVNQLWAGGFAAALDKAMEKAAR

SEQ ID NO: 44427 - protein, 426 aa, Streptomyces zinciresistens K42
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGTEVYHTLKKVLKGRGLSTGLGDEGGFAPNLGSNREALDLILEAIKEAGYAPGEQIALALDVAASEFYKDGKYLFEGKERSAAEMTEYYEELVAAYPLVSVEDPLFEDDWAGWKVLTDKLGDKVQIVGDDLFVTNPERLARGIDDGAANALLVKVNQIGSLTETLDAVELAQRNGFKCMMSHRSGETEDVTIADLAVATNCGQIKTGAPARSERVAKYNQLLRIEEILDDAAVYAGRSAFPRFKG

SEQ ID NO: 44428 - protein, 230 aa, Streptomyces zinciresistens K42
MLFSSKGKHRRPSKAARAVAVVGVTGAAAVAAPLMAAGSASAATASEWDTVAQCESGGNWSINTGNGYYGGLQFSASTWAAYGGTQYASSADQAGKSQQIAIAEKVLAGQGKGAWPNCGTGLSSAAYDGAAAGGSPASGSSQRTERATEQPASRSGERPVAKKSTKTVTTPTGKKVKKGDGEYKVAKGDTLSSIAAEEGVKGGWQKLFKLNKDVVQDADLIYPGQQLHLK

SEQ ID NO: 44429 - protein, 342 aa, Streptomyces zinciresistens K42
MLSGNGRHRRPRQAPALLVAAGVTGSAIAIPLLGASGASAADGTVWDKVADCASGGSWSADTGNGRFGGLQLTQADWEKYGGLDYATSPELASRSQQITVAQAVLADQGVGAWRTCGVLSGLTQKSGALDLDTGVTEDSPSAVSGSSGLLDSVGSSGSSGSDASRPSGASSPSGTSASPSDGPSVSPSGSPESSGKSEGATSSPSSPSKSDNSGKPGKSSGAGTSASPDSSPVESPEGDVKDNWVQDAGSWSLVDTSAVESGPAASGRHRGPSADEKPAANDPKSAGRHASYLVRPGDTLASIADSLDVDGGWRALYEANKRGIGGNANDIAPGQTLDVPVE

SEQ ID NO: 44430 - protein, 186 aa, Streptomyces zinciresistens K42
MKYAPLTIALATALLTAATPGASHAVSAPATAPATQASGTHTSGPPPKPASLTCAKDSWPWSCVAKCESGGDWHINTGNGHYGGLQFSQSTWEGFGGLKYAPRADLASRKEQITVARKVVAVQGWGAWPHCSRRYGLTGRMTWEKPKSEASRKTKRRLTPGALLLMPRGTRLGVPPSETRTRPPRP

SEQ ID NO: 44431 - protein, 240 aa, Streptomyces zinciresistens K42
MSECADTTHAGVRKAPKAPHAGRARTTAVLAGAALLAPLGLLAATGNAAAADSGVWDRIARCESGGNWHINTGNGYYGGLQFAPSTWRAYGGTAYAPTADRASRAQQIAVAIKVQRAQGWGAWPTCSARAGASGGAPAGPATAESPPSSHSSSSSSSSATPSRSSSSAETARSAPASKPQRTPAATSRASSRGEYTVRRGDTLSLIAARHGTTWRPLYAANRSVVGGDPDLIVPGQRLEL

SEQ ID NO: 44432 - protein, 786 aa, Streptomyces zinciresistens K42
MDMPPTRRAFLYAAALAPAAATAPPAPAATAEAAPPAAVPERAAPADPYDALRLRWLDIALGTGYDPAAEPYASRLAETGALARGFRATMAPTPASLWPGHPYDPPAGITRSYLRLWTMAQAHVQEGTGCTGDPGLLADVLRGLDHLSATAYHPGATPYGNWWEWRIGSPRPLMDITAALHDRLGAARVEAACAAVDHFVPDALLTGYSGISTGANRVDLCRSVALRGILGRAPARTALARDALSPVFPHVTEGDGLYADGSFVQHTRVAYSGTYGQVLLDGLGRLFALLAGSAWEVTDPNRQIVLDAVERAYAPLLHDGLVMDGVNGRAISRGYLKDDDRRVMRGDHYHGQGIIAAVALLARAASPAERARWSGLVKGWIERDTVTPILTARQFGTGDLARLHALAASPVPAAPAPTGHHLFAAMDRAVHRRPRFTAHLAMASDRIAYYECGNGENPRGWHTGAGMLSWWPAGRSDQYTDWYWPTVDWYRLPGTTVSTRRLPDRAGGEWGAPRPAVRWVGGATDGEFAVLGQHLRGLGSTLRARKAWFCLDDTVVCLGAGITCADGVPVETVVDNRNLGEGGGQVCVRRPGWAHLEGHGGWVVPGGGLRALREDRTGAWADINTASTAERRTRRWQTLWLDHGTDPVDAAYVYLLMPGARRREVAARAADRRWLAVLANDDARQAVHVLSLGVTAAAFWTAGTAGPLTASAGAAVLLRRRAGAATLWVSEPPRTGEPLEIGWDRPVRRVLRADDAVEILATRPRLRVRVTPGTVCVSHRCEVVPG

SEQ ID NO: 44433 - protein, 512 aa, Streptomyces zinciresistens K42
MSNAQFETYGPSPAQGPPAHGGFDPYRARTQPYGVPRPAVPRTDSDGPGWQRHAGHGSRGAGAEYAAHSRYAGHGQDPEYGEGPEEPGDPEYSEYSEYSEYPEYAEYEPYEDTYRPAYEAADAAYAPGARSTGGRRAAHRRRGRVVERVDGPMRRLVPQALVVAFLAGGTSAFVAKDKAIELNVDGRPRSLHTFADDVGELLAREGVDVGAHDLVTPGPGKALASGDEIAVRHGRPLRLTLDGRRREVWTTADTVEAALRELGVRTEGAYVSVPGSRRIGRGGLGLTVRTERAVTVLADGRSRTVRTNAETVGEVVEQAGITLRGQDSTSAPTESFPRDGQAVTVLRITGGREIRDETIPFAVQRVDDPTVFRGTEVVERAGQHGLRRLTYALRTVNGVRLKPRRIGTEVVREPQTQVVKVGTRPLPTSMNGTGELDWEGLAACESGGRPDAVDSSGTYGGLYQFDTRTWRGLGGQGRPQDAPPAEQTMRAKKLYVRQGASPWPHCGGRLHR

SEQ ID NO: 44434 - protein, 386 aa, Streptomyces zinciresistens K42
MRRIRLKYAGLAALLVLGSWTAVGTGQAAADDAPAEARQQPASEGLLRAMQRDFGLSKQQAQSRLAAERTATTVAPKAREAAGSAYGGAWFDTKSQRLTVAVTSGASAATVREIRAAGAAVRTVEHSARELDATKARLDRLSAPAGVSSWNVDPAANTVVVNVVEGKRADNDVRAFVARARDAGPVTVGTAPAAPRTYAAGTVGGDPYYTGNVRCSIGFSVQGGFVTAGHCGQQGASVRGWDNSYIGTFQGSSFPENDYAWVSVGSGWWTVPVVLGWGTVPDQLVRGSAEAPVGASICRSGSTTRWRCGSVLAKNETVNYQQGAVRQMTKTSVCAEGGDSGGSFISGDQAQGVTSGGWGNCSSGGQTWFQPVNEILGRYGLTLVTA

SEQ ID NO: 44435 - protein, 458 aa, Streptomyces zinciresistens K42
MLGRHTAAGRRAALTALGTLVLTGVTTAAAAEPPPAPLPASVAAQTVGADRPAPAVLRALERDLRLTPGQAAERLVNEAEAGVRAGRLRTALGDRFAGAWLSGSTATDLTVATTDASDVTAITAQGAKAAVVKRTLTDLRAVKEKLDAAAGRVKTLETPVWYVDIPTNRVVVRATKRSAATSFITSAGVRGKGVGVLVSPARPRLLADLVGGEAYYIQNSARCSIGFSVTKGDQQGFASAGHCGNPGDTTSGADMSAQGEFKASTFPGKDMSWVAVNSGWTATADVKGEGGQRTQVTGSVQALVGASVCRSGSTTGWHCGTIQQHDTSVSYSEGTVDGVTETTVCAEPGDSGGPYVSGSQAQGVTSGGSGDCTSGGTTFYQPVNPILSEFGLVLKTATAQQGTPAPQDSAAAAKWAAGRVYEAGTTVTHAGVRYTCLQSHQAQGRWSPTATPSLWQRM

SEQ ID NO: 44436 - protein, 314 aa, Streptomyces zinciresistens K42
MGAAGKLASTLAKDLGAGAAGTYYDAQAKNLVVNVLDETAVTAVEAAGARARVVENSLAELKSARATLKKDAAIPGTAWVTDPATNKVVVSADRTVSRAEWAKLGKIVDGLGAKAELKRAKGEYKPYIAGGDAITGNGGRCSLGFNVTKGGAPFFLTAGHCTAAITTWSDSSGQEIGTNETSSFPDNDYGLVKYTAEVDRPSAVNLYNGSTQAISGAADATVGMQVTRSGSTTQVRDGKVTGLDATVNYGNGDIVNGLIQTDVCAEPGDSGGSLFSGDKAVGLTSGGSGDCTSGGETFFQPVTEALQATGTQIG

SEQ ID NO: 44437 - protein, 301 aa, Streptomyces zinciresistens K42
MRIKRTTPRSGITRRTRLIAVSSGLVAAAAFAIPNATAAETPAAFSATQLKGVSSSVLKADVPGTAWVVDSKTNRVTVTADSTVSQAEIAKIKKQAGADAGALTIKRTAGKFSKFIQGGDAIYAASWRCSLGFNVQDSSGNQYFLTAGHCTNGAGTWYSNSARTAVIGSTSGSSFPGNDYGIVRYSGSVSRPGTANGVDITRAATPSVGTTVIRDGSTTGTRSGRVTALNATVNYGGGDIVSGLIQTTVCAEPGDSGGSLYGSNGTAYGLTSGGSGNCTSGGTTFFQPVTEALSAYGVSIY

SEQ ID NO: 44438 - protein, 394 aa, Streptomyces zinciresistens K42
MAVRGRHRRYQPNRINRASLTVTAGGAGIALPLMGAGTAQAADLDTWNKVAACESTGRWQVNTGNGYYGGLQFAQSTWEAYGGGRYAARADLATKDQQIAVAEKVLDGQGPGAWPTCSQRAGLTRGGDTPDVRPAAARKSTVQDVRPQTTPQSRAGRAEMYTVVRGDTLSGIAETKKVGGGWTGLYAANRATVGADPDLIVPGQRLALRGKAAGAAPEAKPEAAAKKSAPKKNTPKESARKKSAPKRTAEDHRERADRSARSLVAPVGAATGTPYRKAGSLWSKGYHTGLDFPVPTGTSVKSVGAGQIVSAGWAGSFGYQVIVRHGDGRYSQYAHLSAISVRAGQSVGAGQRIGRSGNTGNSTGPHLHFEVRTGPGFGSDVDPVAYLRAGGVRI

SEQ ID NO: 44439 - protein, 143 aa, Streptomyces zinciresistens K42
MRNTARWAATLALTATAVCGPLTGAALAAPATPDSLHAPSALVLAVAYGDDATLAAPARAVTLSCAPTASGSHPDARSACAELRGAQGDFDALRAREDVLCTKQYAPVVITVDGVWQGRRVSYERTFANECVKGSYGTSLFAF

SEQ ID NO: 44440 - protein, 462 aa, Streptomyces zinciresistens K42
MSHKRIPKRKAAIAAGGVVALGAAAILLPNANASQDAASDAAPRTLKAADASQLAARLAGALGDAFAGSYYDAGGRQLVVNVVAGDNDNVIVQAERAGAKVREVRNSLAALRTGAQTLRSEAAVPGTAWAVDPRTNKILVTADRTVTGGDWDRLESTVKGLGSGIADVKRSKGTFKTFLSGGDAIFAGGARCSAGFNVTAGDGTPAFLTAGHCGVAAAQWSDSQGGRPIATVDQATFPGAGDFALVKYDDPATQAPSEVNVGQQTVAISQAADAAVGLQVFRMGSTTGLNNGQVTGVDATVNYPEGTVTGLIQTDVCAEPGDSGGSLFTQDGLAIGLTSGGSGDCTVGGETFFQPVTTALQAVGATLGDGAGGAGAGAGAGQGAGDQAGQGAGDGAGDQAGQGAGAGAGAGDQAGAGQEAGAGQGPGAGQGVGGGNADGSGKAGAPGSGDGLGRIVGSGGGD

SEQ ID NO: 44441 - protein, 430 aa, Streptomyces zinciresistens K42
MVTRAVASEPPAATGVPRTFAASAARTGGELVARLGPSRTAGSWIGADGKPVVAVTDARTAAEVRAAGATAKTVRRSMAELRSATAALRSAPRVAGTAWRLDYRSNQVVVRGDSTVSAGDWSRLTGVADGIGSFVRMERTEGMFTTRLNGALPLLSTAGRCSAGFNVTDGTRDFILTAGHCGPRGSVWFADTRGTRQIGRTVQQSFPGGDFSLVQYAGGDAGAGADVVSIGGGKGVRITGAADPAVGQRVFRSGSTSGLRDGEVTALDATVNYPEGTVTGLIETNVCAEPGDSGGPMFSEGIALGVTSGGSGDCAAGGTTFFQPVTKALAALGKNLIVAAGNGAAQGAAPAPPASRGTGAGAPGEAAPGSSAAVTGERAVTPLARLTDPRNVGPGLLVVAGSVAALGATRFIRAEQDRKAYRQRYSATWG

SEQ ID NO: 44442 - protein, 310 aa, Streptomyces zinciresistens K42
MAALIATVLTPGRAAAASLREVTGFGSNPGALRMYRYVPDALPAGRPVVVALHGCTQNAAGYGTGSGWTQLADRWGFSVVLPQQQSANNATSCFNWFQTGDIARGQGEAASVAQMVDRQLADAAGDASRVYVTGLSAGGAMTAVMMAAYPEKFAAGGIAAGLPYGCAQAAGSPYVCMYVGATQSAQQWGDRVRAARPGYPGPWPTLVAFQGTADYTVKPVNMTDLTRQWTAVRGADQVADVSDSVAGYPHQVFRDPAGRTAVETYSITGMGHGQPVDPGSGAEQCGTAGAYVLDVNLCAAYRMGRAWGLG

SEQ ID NO: 44443 - protein, 247 aa, Streptomyces zinciresistens K42
AAAPPAAAPRAAAGLDDPAKKEIAMQLVSSAENSSLDWKAQYKYIEDIGDGRGYTAGIIGFCSGTGDMLDLVELYTSRRPGNVLSGYLPALRRVDGTASHAGLDPDYPRDWARAAQDQAFRQAQDDERDRVYFNPAVRQGRTDGLRVLGQFAYYDAIVMHGDGGDPTSFRSIRARALNSARPPAQGGDEAIYLNAFLDARVWAMQQEEAHSDTSRVDTAQRVFLRDGNLDLNTPLAWKVYGDSFRIG

SEQ ID NO: 44444 - protein, 229 aa, Streptomyces zinciresistens K42
MSKQKRTAALATAAALAGSAVLMAAPAARAAVVDVNYACKTPIGDKSAVSPIDIKGVRSGAGYKITMSWQKGVSSSPVELGKGAMNPSATIRLGGAESGTLNVTGPANQQAVPANTPIRISDLTGTYTPRKTGKVTFTAGVLTIKALGTTTTCTPSNSPGPSLTLDVTAAGGSGGTGGTPGGGSAPGAELPQTGPEDSAIALGTLGGTVLLAGAAGALWLTRRHRTAQR

SEQ ID NO: 44445 - protein, 428 aa, Tropheryma whipplei
  strain TW08/27 Whipple's bacillus
MCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 44446 - protein, 428 aa, Tropheryma whipplei; identical to SEQ ID NO: 44445
  strain Twist Whipple's bacillus

SEQ ID NO: 44447 - protein, 185 aa, Bacillus subtilis
  strain 168
MSKEVLTQTKEKMEKAIAAYQRELATVRAGRANPSLLDKVTVEYYGAQTPLNQLSSINVPEARMLVITPYDKTAIGDIEKAILKADLGLTPTSDGNMIRIAIPALTEERRKELVKVVKKYAEEAKVAVRNVRRDANDDLKKLEKNGDITEDELRASTEDVQKLTDEYVSKIDSVTKDKEKEIMEV

SEQ ID NO: 44448 - protein, 227 aa, Bacillus subtilis
  strain 168
MKKRFSLIMMTGLLFGLTSPAFAAEKTETEAKAPANVAVLLDASGSMAKRIDGVSKFNSAKKEISKFASSLPEGTQVKMSVFGSEGNNKNSGKVQSCEAIRNVYGFQSFNEQSFLNSLNTIGPTGWTPIAKALNEAKSSFDQLDAKGEKVVYLLTDGEETCGGNPIKTAKELQKDNITVNVIGFDYKEGYKGQLNAIAKVGGGEYFPAYTQKDVEKIFTQQSLMLSK

SEQ ID NO: 44449 - protein, 103 aa, Bacillus subtilis
  strain 168
MHVKKGDKVMVISGKDKGKQGTILAAFPKKDRVLVEGVNMVKKHSKPTQANPQGGISNQEAPIHVSNVMPLDPKTGEVTRVGYKVEDGKKVRVAKKSGQVLDK

SEQ ID NO: 44450 - protein, 306 aa, Bacillus subtilis; identical to SEQ ID NO: 307
  strain 168

SEQ ID NO: 44451 - protein, 35 aa, Bacillus subtilis
  strain 168
MGKGRIRVEERIKAETDAEMQKATLLDQTQTKKGK

SEQ ID NO: 44452 - protein, 224 aa, Bacillus subtilis
  strain 168
MKKLLAAGIIGLLTVSIASPSFAAEKQADTNVAVLFDGSGSMVQKTGGERKIDIAKKSVKSFAELLPKDTNLMLRVFGHAGNNKLSGKALSCSTTETIYGLHPYEGSLFDNSLSELKPTGWTPIAKALADTRKEFEAFDADGKNVVYLITDGEETCGGDPAAEIEKLRASNVDTIVNIIGFNFDVKGNEEMKQAAVAGGGEYISANSADEFEQAWEKEAQKFTE

SEQ ID NO: 44453 - protein, 157 aa, Bacillus subtilis
  strain 168
MAQEKVFPMTAEGKQKLEQELEYLKTVKRKEVVERIKIARSFGDLSENSEYDSAKEEQAFVEGRVTTLENMIRNAKIIEDDGGSNVVGLGKTVTFVELPDGDEESYTIVGSAEADPFEGKISNDSPIAKSLLGKKVDEEVTVQTPGGEMLVKIVKIS

SEQ ID NO: 44454 - protein, 841 aa, Bacillus subtilis
  strain 168
MLGILNKMFDPTKRTLNRYEKIANDIDAIRGDYENLSDDALKHKTIEFKERLEKGATTDDLLVEAFAVVREASRRVTGMFPFKVQLMGGVALHDGNIAEMKTGEGKTLTSTLPVYLNALTGKGVHVVTVNEYLASRDAEQMGKIFEFLGLTVGLNLNSMSKDEKREAYAADITYSTNNELGFDYLRDNMVLYKEQMVQRPLHFAVIDEVDSILIDEARTPLIISGQAAKSTKLYVQANAFVRTLKAEKDYTYDIKTKAVQLTEEGMTKAEKAFGIDNLFDVKHVALNHHINQALKAHVAMQKDVDYVVEDGQVVIVDSFTGRLMKGRRYSEGLHQAIEAKEGLEIQNESMTLATITFQNYFRMYEKLAGMTGTAKTEEEEFRNIYNMQVVTIPTNRPVVRDDRPDLIYRTMEGKFKAVAEDVAQRYMTGQPVLVGTVAVETSELISKLLKNKGIPHQVLNAKNHEREAQIIEEAGQKGAVTIATNMAGRGTDIKLGEGVKELGGLAVVGTERHESRRIDNQLRGRSGRQGDPGITQFYLSMEDELMRRFGAERTMAMLDRFGMDDSTPIQSKMVSRAVESSQKRVEGNNFDSRKQLLQYDDVLRQQREVIYKQRFEVIDSENLREIVENMIKSSLERAIAAYTPREELPEEWKLDGLVDLINTTYLDEGALEKSDIFGKEPDEMLELIMDRIITKYNEKEEQFGKEQMREFEKVIVLRAVDSKWMDHIDAMDQLRQGIHLRAYAQTNPLREYQMEGFAMFEHMIESIEDEVAKFVMKAEIENNLEREEVVQGQTTAHQPQEGDDNKKAKKAPVRKVVDIGRNAPCHCGSGKKYKNCCGRTE

SEQ ID NO: 44455 - protein, 277 aa, Bacillus subtilis
  strain 168
MAIKKYKPTSNGRRGMTTSDFAEITTDKPEKSLLAPLHKKGGRNNQGKLTVRHQGGGHKRQYRVIDFKRDKDGIPGRVATVEYDPNRSANIALINYADGEKRYILAPKGIQVGTEIMSGPEADIKVGNALPLINIPVGTVVHNIELKPGKGGQLVRSAGTSAQVLGKEGKYVLVRLNSGEVRMILSACRASIGQVGNEQHELINIGKAGRSRWKGIRPTVRGSVMNPNDHPHGGGEGRAPIGRKSPMSPWGKPTLGFKTRKKKNKSDKFIVRRRKNK

SEQ ID NO: 44456 - protein, 49 aa, Bacillus subtilis
  strain 168
MRVNITLACTECGERNYISKKNKRNNPDRVEFKKYCPRDKKSTLHRETK

SEQ ID NO: 44457 - protein, 396 aa, Bacillus subtilis
  strain 168
MKKTLALAATAAVLMLSACSSGFGGEKEEEITQKTAKSSEKAIVPKYNISDSYYKMVLPFKAGKARGLTTEQLNTRLDIDEFETGLMRLAQDSFSTDDYLFQEGQYLDEDTVLSWLARKKTGSDLKKAEKEDKNFKNEGLNPALPSSGSTEEKNESSPIYLASMLEHDYLVRKDKNSIQLGGVMIGLALNSVYYYREKTGDPQKEVEIKDSTLRQQGEKIAQEVINRLRKKDNLKNVPITVALYKQASKTSIVPGNFIAKTEVKAGSTDISNWDDINEKYVFYPADTTTAEKYPDDTEVFKRFKNSIEEYFPNYTGVVGTALYENDEMKKMKIDIPMQFYGKSEVVAFTQFLTGEVMDYYSKSSVDVEVNITSSDGQEAVIIRNAGDKEPTVHIYD

SEQ ID NO: 44458 - protein, 55 aa, Bacillus subtilis
  strain 168
MKFVKAIWPFVAVAIVFMFMSAFKFNDQLTDQEKQKIDMEMNKIQQQEEPVNANK

SEQ ID NO: 44459 - protein, 77 aa, Bacillus subtilis
  strain 168
MADTLERVTKIIVDRLGVDEADVKLEASFKEDLGADSLDVVELVMELEDEFDMEISDEDAEKIATVGDAVNYIQNQQ

SEQ ID NO: 44460 - protein, 236 aa, Bacillus subtilis
  strain 168
MKMMDANEIISFIQNSTKSTPVKVYVKGELEGINFGESAKAFINGNTGVVFGEWSEIQTAIEENQSKIEDYVVENDRRNSAIPMLDLKNIKARIEPGAIIRDQVEIGDNAVIMMGASINIGSVIGEGTMIDMNVVLGGRATVGKNCHIGAGSVLAGVIEPPSAKPVVIEDDVVIGANAVVLEGVTVGKGAVVAAGAIVVNDVEPYTVVAGTPAKKIKDIDEKTKGKTEIKQELRQL

SEQ ID NO: 44461 - protein, 290 aa, Bacillus subtilis
  strain 168
MLKDIFTKKKKYASVPSDQAKHDVPEGIMTKCPKCKKIMLTKELDKNMRVCMNCDYHFPMNAKQRIESLMDEQSFEEFNQGMLSENPLGFPGYLEKLEKDREKTSLNEAVVTGKGTIGGHPAVVAVMDSSFRMGSMGSVVGEKITLAIEKAKADKVPFIIFTASGGARMQEGVLSLMQMAKTSSALKLFSEEQGLIISVMTHPTTGGVSASFASLGDYNFAEPGALIGFAGRRIIEQTIGEKLPEDFQTAEFLLKHGQLDAVIHRDDMKKTLENLLDMHQTGGDIEWLQD

SEQ ID NO: 44462 - protein, 132 aa, Bacillus subtilis
  strain 168
MKTVKVNIVTPDGPVYDADIEMVSVRAESGDLGILPGHIPTVAPLKIGAVRLKKDGQTEMVAVSGGFVEVRPDHVTILAQAAETAEGIDKERAEAARQRAQERLNSQSDDTDIRRAELALQRALNRLDVAGK

SEQ ID NO: 44463 - protein, 288 aa, Bacillus subtilis; identical to SEQ ID NO: 309
  strain 168

SEQ ID NO: 44464 - protein, 334 aa, Bacillus subtilis
  strain 168
MSNITIYDVAREANVSMATVSRVVNGNPNVKPTTRKKVLEAIERLGYRPNAVARGLASKKTTTVGVIIPDISSIFYSELARGIEDIATMYKYNIILSNSDQNMEKELHLLNTMLGKQVDGIVFMGGNITDEHVAEFKRSPVPIVLAASVEEQEETPSVAIDYEQAIYDAVKLLVDKGHTDIAFVSGPMAEPINRSKKLQGYKRALEEANLPFNEQFVAEGDYTYDSGLEALQHLMSLDKKPTAILSATDEMALGIIHAAQDQGLSIPEDLDIIGFDNTRLSLMVRPQLSTVVQPTYDIGAVAMRLLTKLMNKEPVEEHIVELPHRIELRKSTKS

SEQ ID NO: 44465 - protein, 67 aa, Bacillus subtilis
  strain 168
MLEGKVKWFNSEKGFGFIEVEGQDDVFVHFSAIQGEGFKTLEEGQAVSFEIVEGNRGPQAANVTKEA

SEQ ID NO: 44466 - protein, 261 aa, Bacillus subtilis
  strain 168
MNAKGIEGKIAFITGAAQGIGEAVARTLASQGAHIAAVDYNPEKLEKVVSSLKAEGRHAEAFPADVRDSAAIDEITARIEREMGPIDILVNVAGVLRPGLIHSLSDEEWEATFSVNSTGVFNASRSVSKYMMDRRSGSIVTVGSNAAGVPRTSMAAYASSKAAAVMFTKCLGLELAEYNIRCNIVSPGSTETDMQWSLWADENGAEQVIKGSLETFKTGIPLKKLAKPSDIADAVLFLVSGQAGHITMHNLCVDGGATLGV

SEQ ID NO: 44467 - protein, 539 aa, Bacillus subtilis
  strain 168
MLKGFTPWPDELAETYRKNGCWAGETFGDLLRDRAAKYGDRIAITCGNTHWSYRELDTRADRLAAGFQKLGIQQMDRVVVQLPNIKEFFEVIFALFRLGALPVFALPSHRSSEITYFCEFAEAAAYIIPDAYSGFDYRSLARQVQSKLPTLKNIIVAGEAEEFLPLEDLHAEPVKLPEVKSSDVAFLQLSGGSTGLSKLIPRTHDDYIYSLKRSVEVCWLDHSTVYLAALPMAHNYPLSSPGVLGVLYAGGRVVLSPSPSPDDAFPLIEREKVTITALVPPLAMVWMDAASSRRDDLSSLQVLQVGGAKFSAEAARRVKAVFGCTLQQVFGMAEGLVNYTRLDDPEEIIVNTQGKPMSPYDEMRVWDDHDRDVKPGETGHLLTRGPYTIRGYYKAEEHNAASFTEDGFYRTGDIVRLTRDGYIVVEGRAKDQINRGGEKVAAEEVENHLLAHPAVHDAAMVSMPDQFLGERSCVFIIPRDEAPKAAELKAFLRERGLAAYKIPDRVEFVESFPQTGVGKVSKKALREAISEKLLAGFKK

SEQ ID NO: 44468 - protein, 317 aa, Bacillus subtilis
  strain 168
MKKISLTLLILLLALTAAACGSKNESTASKASGTASEKKKIEYLDKTYEVTVPTDKIAITGSVESMEDAKLLDVHPQGAISFSGKFPDMFKDITDKAEPTGEKMEPNIEKILEMKPDVILASTKFPEKTLQKISTAGTTIPVSHISSNWKENMMLLAQLTGKEKKAKKIIADYEQDLKEIKTKINDKAKDSKALVIRIRQGNIYIYPEQVYFNSTLYGDLGLKAPNEVKAAKAQELSSLEKLSEMNPDHIFVQFSDDENADKPDALKDLEKNPIWKSLKAVKEDHVYVNSVDPLAQGGTAWSKVRFLKAAAEKLTQN

SEQ ID NO: 44469 - protein, 157 aa, Bacillus subtilis
  strain 168
MPSVESFELDHNAVVAPYVRHCGVHKVGTDGVVNKFDIRFCQPNKQAMKPDTIHTLEHLLAFTIRSHAEKYDHFDIIDISPMGCQTGYYLVVSGEPTSAEIVDLLEDTMKEAVEITEIPAANEKQCGQAKLHDLEGAKRLMRFWLSQDKEELLKVFG

SEQ ID NO: 44470 - protein, 143 aa, Bacillus subtilis
  strain 168
MKTGYFLLEDGNKIEFELYPEAAPGTVANFEKLANEGFYDGLTFHRVIPGFVSQGGCPHGTGTGGPGYTIKCETEGNPHTHEAGALSMAHAGKDTGGSQFFIVHEPQPHLNGVHTVFGKVTSGLEFAKNMSNGDVMKEVRVEG

SEQ ID NO: 44471 - protein, 120 aa, Bacillus subtilis
  strain 168
MITKTSKNAARLKRHARVRAKLSGTAERPRLNVFRSNKHIYAQIIDDVNGVTLASASTLDKDLNVESTGDTSAATKVGELVAKRAAEKGISDVVFDRGGYLYHGRVKALADAAREAGLKF

SEQ ID NO: 44472 - protein, 37 aa, Bacillus subtilis
  strain 168
MKVRPSVKPICEKCKVIRRKGKVMVICENPKHKQKQG

SEQ ID NO: 44473 - protein, 179 aa, Bacillus subtilis
  strain 168
MSRVGKKLLEIPSDVTVTLNDNNTVAVKGPKGELTRTFHPDMEIKVEDNVLTVARPSDQKEHRALHGTTRSLLGNMVEGVSKGFERGLELVGVGYRASKSGNKLVLNVGYSHPVEIVPEEGIEIEVPSQTKVVVKGTDKERVGAIAANIRAVRSPEPYKGKGIRYEGEVVRRKEGKSAK

SEQ ID NO: 44474 - protein, 61 aa, Bacillus subtilis
  strain 168
MAKKSMIAKQQRTPKFKVQEYTRCERCGRPHSVIRKFKLCRICFRELAYKGQIPGVKKASW

SEQ ID NO: 44475 - protein, 246 aa, Bacillus subtilis
  strain 168
MSVISMKQLLEAGVHFGHQTRRWNPKMKRYIFTERNGIYIIDLQKTVKKVEEAYNFTKNLAAEGGKILFVGTKKQAQDSVKEEAQRSGMYYVNQRWLGGTLTNFETIQKRIKRLKDIEKMQENGTFDVLPKKEVVQLKKELERLEKFLGGIKDMKDLPDALFIIDPRKERIAVAEARKLNIPIIGIVDTNCDPDEIDVVIPANDDAIRAVKLLTSKMADAILEAKQGEEEAEVAEETAPETETTTA

SEQ ID NO: 44476 - protein, 88 aa, Bacillus subtilis
  strain 168
MPNIKSAIKRTKTNNERRVHNATIKSAMRTAIKQVEASVANNEADKAKTALTEAAKRIDKAVKTGLVHKNTAARYKSRLAKKVNGLSA

SEQ ID NO: 44477 - protein, 97 aa, Bacillus subtilis
  strain 168
MEVTDVRLRRVNTDGRMRAIASITLDHEFVVHDIRVIDGNNGLFVAMPSKRTPDGEFRDITHPINSSTRGKIQDAVLNEYHRLGDTEALEFEEAGAS

SEQ ID NO: 44478 - protein, 1052 aa, Bacillus subtilis
  strain 168
MNHVINFVLKNKFAVWLMTIIVTAAGLYAGMNMKQESIPDVNMPYLTISTTYPGATPSQVADEVTKPVEQAVQNLDGVSVVTSTSYENASSVMIEYDYEKDMDKAKTEAAEALENVNLPDDAKDPEISRYSLNSFPILTLSVSSDKDNLQELTKQVEDSLVSKLEGIEGVASVQVSGQQVEEVEFSFKEDKLKEYGLDEDTVKQVIQGSDVTTPLGLYTFGNEEKSVVVSGDIETIKDLKNMRIPTASASSAGSSAASQAGAQSAQAAQSAQAAAQVQQSASTAVPTVKLSDIATIKDVKKAESVSRTNGKDSIGINIVKANDANTVEVADDVKAELKKFKEDHKGFNYSATLDMAEPITQSVDTMLSKAIFGAIFAIVIILLFLRDIKSTLISVVSIPLSLLIALLVLQQLDITLNIMTLGAMTVAIGRVVDDSIVVIENIYRRMRLKDEPLRGKALVREATKEMFKPIMSSTIVTIAVFLPLALVGGQIGELFIPFALTIVFALAASLVISITLVPMLAHSLFKKSLTGAPIKAKEHKPGRLANIYKKVLNWALSHKWITSIIAVLMLLGSLFLVPLIGASYLPSEEEKTMQLTYSPEPGETKKEAENEAEKAEKILLDRKHVDTVQYSLGSGSPLAGGDSNGALFYIKYESDTPDFDKEKDNVLKEIQKQSDRGEWKSQDFSSSGNNNELTYYVYGDSENDIKDTVKDIEKIMKDEKDLKNVNSGLSSTYDEYTFVADQEKLSKLGLTASQISQALMSQTSQEPLTTVKKDGKELDVNIKTEKDEYKSVKDLENKKITSATGQEVKIGDVAKVKEGSTSDTVSKRDGKVYADVTGEVTSDNVTAVSAAIQKKIDKLDHPDNVSIDTGGVSADIADSFTKLGLAMLAAIAIVYLVLVITFGGALAPFAILFSLPFTVIGALVGLYVSGETISLNAMIGMLMLIGIVVTNAIVLIDRVIHKEAEGLSTREALLEAGSTRLRPILMTAIATIGALIPLALGFEGGSQVISKGLGVTVIGGLISSTLLTLLIVPIVYEVLAKFRKKKPGTEEE

SEQ ID NO: 44479 - protein, 89 aa, Bacillus subtilis
  strain 168
MKKAAAVLLSLGLVFGFSYGAGHVAEAKTKVKVYKNCKELNKVYKGGVARTSKVKNKGGKTKYKPYVSKALYDANKNKDRDKDLIACER

SEQ ID NO: 44480 - protein, 163 aa, Bacillus subtilis
  strain 168
MAKESSFDIVSKVELPEVQNAIQIALKEISTRYDFKGSKSDISLDKEELVLVSDDEFKLSQLKDVLVSKLIKRNVPTKNIDYGKVENASGGTVRQRAKLVQGIDKDNAKKINTIIKNSGLKVKSQVQDDQVRVTGKNKDDLQQIISAVRGADLPIDVQFINFR

SEQ ID NO: 44481 - protein, 194 aa, Bacillus subtilis
  strain 168
MKKAFLVFLSVVLVTTVFLVKQQESVAQAKQLEYSGEEIFKGFVFAQGEVGKQLPEVFNKAMTDKLNTKQAKAFANQVVADIKKEDADFFDNLKKAVYSKDALKVDELLKKAGQIVEEKVEAAKEIAASKDDTSRVQAELVNTVDTANYFYYVSYVAAAGALILIILAIDITPIAISDNVDREMAIRTLVDELN

SEQ ID NO: 44482 - protein, 148 aa, Bacillus subtilis
  strain 168
MSLLERLNQDMKLYMKNREKDKLTVVRMVKASLQNEAIKLKKDSLTEDEELTVLSRELKQRKDSLQEFSNANRLDLVDKVQKELDILEVYLPEQLSEEELRTIVNETIAEVGASSKADMGKVMGAIMPKVKGKADGSLINKLVSSQLS

SEQ ID NO: 44483 - protein, 321 aa, Bacillus subtilis
  strain 168
MKKNILLVGMLVLLLMFVSACSGTASKGSSSDSASEKTEMRTYKSPKGNVNIPAHPKRIVTDFYAGELLSVGANVVGSGSWSFDNPFLKSKLKNVKDVGDPISVEKVMELQPDLIVVMNEENVDKLKKIAPTVVIPYNTAKNVEDTVSMFGDIAGAKDQAKSFMADFNKKAEAAKKKIAGVIDKDATFGIYENTDKGEFWVFNDNGGRGGQAVYNALGLKAPEKIEQDVIKKGEMKQLSQEVIPEYAADYMFITDYNPKGESKTLDKLENSSIWKNLDAVKHNRVFINDFDSFYPYDPISVSKQVDIITDMLIKRAEENKK

SEQ ID NO: 44484 - protein, 6 aa, Artificial Sequence
  Description of Artificial Sequence: Synthetic 6xHis tag
HHHHHH

SEQ ID NO: 44485 - protein, 4 aa, Bacillus subtilis
YAAI

SEQ ID NO: 44486 - protein, 4 aa, Bacillus subtilis
NTSA

SEQ ID NO: 44487 - protein, 6 aa, Bacillus subtilis
SHYASD

SEQ ID NO: 44488 - protein, 4 aa, Bacillus subtilis
QPEE
